(12) United States Patent
Freier

(10) Patent No.: US 12,168,766 B2
(45) Date of Patent: *Dec. 17, 2024

(54) MODULATORS OF APOL1 EXPRESSION

(71) Applicant: Ionis Pharmaceuticals, Inc., Carlsbad, CA (US)

(72) Inventor: Susan M. Freier, San Diego, CA (US)

(73) Assignee: ASTRAZENECA AB, Sodertalje (SE)

(*) Notice: Subject to any disclaimer, the term of this patent is extended or adjusted under 35 U.S.C. 154(b) by 77 days.

This patent is subject to a terminal disclaimer.

(21) Appl. No.: 18/053,447

(22) Filed: Nov. 8, 2022

(65) Prior Publication Data

US 2023/0265428 A1    Aug. 24, 2023

Related U.S. Application Data

(63) Continuation of application No. 17/025,239, filed on Sep. 18, 2020, now Pat. No. 11,525,136, which is a continuation of application No. 16/418,060, filed on May 21, 2019, now Pat. No. 10,927,377.

(60) Provisional application No. 62/674,865, filed on May 22, 2018.

(51) Int. Cl.
| C07H 21/04 | (2006.01) |
| A61P 13/02 | (2006.01) |
| C12N 15/113 | (2010.01) |

(52) U.S. Cl.
CPC ............ *C12N 15/113* (2013.01); *A61P 13/02* (2018.01); *C12N 2310/11* (2013.01); *C12N 2310/315* (2013.01); *C12N 2310/321* (2013.01); *C12N 2310/3231* (2013.01); *C12N 2310/3341* (2013.01); *C12N 2310/341* (2013.01); *C12N 2310/346* (2013.01); *C12N 2320/32* (2013.01); *C12N 2320/35* (2013.01)

(58) Field of Classification Search
None
See application file for complete search history.

(56) References Cited

U.S. PATENT DOCUMENTS

| 2002/0058798 A1 | 5/2002 | Wallach et al. |
| 2003/0028013 A1 | 2/2003 | Wang |
| 2005/0171044 A1 | 8/2005 | Stein et al. |
| 2005/0228172 A9 | 10/2005 | Wang |
| 2007/0054278 A1 | 3/2007 | Cargill |
| 2010/0105760 A1 | 4/2010 | Collard et al. |
| 2011/0118334 A1 | 5/2011 | Iversen |
| 2011/0237649 A1 | 9/2011 | Collard et al. |
| 2012/0003644 A1 | 1/2012 | Skorecki et al. |
| 2012/0128682 A1 | 5/2012 | Pays et al. |
| 2012/0195902 A1 | 8/2012 | Friedman et al. |
| 2012/0329727 A1 | 12/2012 | Collard et al. |
| 2015/0152411 A1 | 6/2015 | Crooke et al. |
| 2015/0297598 A1 | 10/2015 | Friedman et al. |
| 2016/0003808 A1 | 1/2016 | Janssen et al. |
| 2016/0138029 A1 | 5/2016 | Hossbach et al. |
| 2016/0145617 A1 | 5/2016 | Kordasiewicz et al. |

FOREIGN PATENT DOCUMENTS

| JP | 2015507924 A | 3/2015 |
| WO | 0228999 A2 | 4/2002 |
| WO | 2006034348 A2 | 3/2006 |
| WO | 2007138023 A1 | 12/2007 |
| WO | 2008050329 A2 | 5/2008 |
| WO | 2012162394 A2 | 11/2012 |
| WO | 2014078213 A2 | 5/2014 |
| WO | 2014085154 A1 | 6/2014 |
| WO | 2014139885 A2 | 9/2014 |
| WO | 2014203008 A1 | 12/2014 |
| WO | 2015010135 A2 | 1/2015 |
| WO | 2015136509 A2 | 9/2015 |
| WO | 2015143246 A1 | 9/2015 |
| WO | 2016205581 A1 | 12/2016 |
| WO | 2017004243 A1 | 1/2017 |
| WO | 2017053722 A1 | 3/2017 |
| WO | 2019226611 A1 | 11/2019 |

OTHER PUBLICATIONS

Parsa, Afshin, et al. "APOL1 risk variants, race, and progression of chronic kidney disease." New England Journal of Medicine 369.23 (2013): 2183-2196.*

Ito, Kaoru, et al. "Increased burden of cardiovascular disease in carriers of APOL1 genetic variants." Circulation research 114.5 (2014): 845-850.*

Chaudhary, Ninad S., et al. "APOL1 nephropathy risk alleles and risk of sepsis in blacks." Clinical Journal of the American Society of Nephrology 14.12 (2019): 1733-1740.*

Cheatham A.M., et al., "Blocking the 5' Splice Site of Exon 4 by a Morpholino Oligomer Triggers APOL1 Protein Isoform Switch", Scientific Reports, vol. 8, No. 1, Article No. 8739, Jun. 7, 2018, pp. 1-12.

Khatua A.K., et al., "Exon 4-Encoded Sequence is a Major Determinant of Cytotoxicity of Apolipoprotein L1", American Journal of physiology, Cell physiology, vol. 309, No. 1, 2015, pp. C22-C37.

Aghajan Mariam et al: "Antisense oligonucleotide treatment ameliorates IFN-[gamma]-induced proteinuria in APOL1-transgenic mice", JCI Insight, vol. 4, No. 12, Jun. 20, 2019 (Jun. 20, 2019).

Brauweiler Anne M. et al: "Interferon-[gamma] Protects from Staphylococcal Alpha Toxin-Induced Keratinocyte Death through Apolipoprotein LI", Journal of Investigative Dermatology, vol. 136, No. 3, Mar. 1, 2016 (Mar. 1, 2016) , pp. 658-664.

International Search Report and Written Opinion for PCT/US2019/033244, dated Oct. 16, 2019.

Genovese, Giulio, el al. "Association of trypanolylic Apol 1 variants with kidney disease in African Americans." Science 329.5993 (2010): 841-845.

Anderson B.R., et al., "In Vivo Modeling of Genetic Mechanisms Associated with Sickle Cell Disease Nephropathy", Blood, vol. 122, No. 21, Nov. 15, 2013, 2 pages.

(Continued)

*Primary Examiner* — Kimberly Chong

(57) ABSTRACT

The present embodiments provide methods, compounds, and compositions useful for inhibiting APOL1 expression, which may be useful for treating, preventing, or ameliorating a disease associated with APOL1.

12 Claims, No Drawings

Specification includes a Sequence Listing.

(56) References Cited

OTHER PUBLICATIONS

He Z., "The Study of Transcription Regulation of Apolipoprotein L1", China Master's Theses Full-text Database, Dec. 15, 2015, 48 pages.

Heymann J., et al., "Therapeutics for APOL1 Nephropathies: Putting out the Fire in the Podocyte", Nephrology, dialysis, transplantation: Official Publication of the European Dialysis and Transplant Association—European Renal Association, 2017, vol. 32(suppl_1), pp. i65-i70.

International Preliminary Report on Patentability for International Application No. PCT/US2019/033244, mailed Dec. 3, 2020, 9 Pages.

Monia B.P., et al., "Evaluation of 2'-Modified Oligonucleotides Containing 2'-Deoxy Gaps as Antisense Inhibitors of Gene Expression," Journal of Biological Chemistry, Jul. 5, 1993, vol. 268, No. 19, pp. 14514-14522.

Olabisi O. A., et al., "APOL1 Kidney Disease Risk Variants cause Cytotoxicity by Depleting Cellular Potassium and Inducing Stress-Activated Protein Kinases", Proceedings of the National Academy of Sciences of the United States of America, Jan. 26, 2016, vol. 113, No. 4, pp. 830-837.

Olabisi O.A., et al., "APOL1 Nephrotoxicity: What Does Ion Transport Have to Do With It?", Seminars in Nephrology, Nov. 2017, vol. 37, No. 6, pp. 546-551.

O'Toole J.F., et al., "The Cell Biology of APOL1", Seminars in Nephrology, Nov. 2017, vol. 37, No. 6, pp. 538-545.

Search Report for Chinese Patent Application No. 201980033544.9, mailed May 23, 2023, 3 Pages.

Search Report for Colombian Patent Application No. 20200015377, mailed on Apr. 18, 2023, 2 Pages.

Wang D., "Preliminary Study of Apolipoprotein L1 Regulatory Mechanism", China Master's Theses Full-text Database, Jan. 15, 2014, 62 pages.

Kotb A.M., et al., "Knockdown of ApoL1 in Zebrafish Larvae Affects the Glomerular Filtration Barrier and the Expression of Nephrin", PLoS One, May 3, 2016, vol. 11, No. 5, 17 Pages.

Nichols B., et al., "Innate Immunity Pathways Regulate the Nephropathy Gene Apolipoprotein L1", Kidney International, Feb. 2015, vol. 87, No. 2, pp. 332-342.

Freedman B.I., et al., "End-Stage Renal Disease in African Americans With Lupus Nephritis Is Associated With APOL1", Arthritis Rheumatology, Feb. 2014, vol. 66, No. 2, pp. 390-396.

Kopp J.B., et al., "APOL1 Genetic Variants in Focal Segmental Glomerulosclerosis and HIV-Associated Nephropathy", Journal of the American Society of Nephrology: JASN, 2011, vol. 22, pp. 2129-2137.

Kopp J.B., "Rethinking Hypertensive Kidney Disease: Arterionephrosclerosis as a Genetic, Metabolic, and Inflammatory Disorder", Current Opinion in Nephrology and Hypertension, May 2013, vol. 22, No. 3, pp. 266-272.

Kormann R., et al., "Roles of APOL1 G1 and G2 Variants in Sickle Cell Disease Patients: Kidney is the Main Target", British Journal of Haematology, Jul. 12, 2017, vol. 179, pp. 323-335.

Larsen C.P., et al., "Apolipoprotein L1 Risk Variants Associate with Systemic Lupus Erythematosus-Associated Collapsing Glomerulopathy", Journal of the American Society of Nephrology: JASN, 2013, vol. 24, No. 5, pp. 722-725.

Lipkowitz M.S., et al., "Apolipoprotein L1 Gene Variants Associate with Hypertension-attributed Nephropathy and the Rate of Kidney Function Decline in African Americans", Kidney International, Clinical Investigation, Jul. 25, 2012, vol. 83, pp. 114-120.

\* cited by examiner

MODULATORS OF APOL1 EXPRESSION

SEQUENCE LISTING

The present application is being filed along with a Sequence Listing in electronic format. The Sequence Listing is provided as a file entitled 200779-US-CNT_2_SL.xml created Sep. 28, 2023, which is 2,547,176 bytes in size. The information in the electronic format of the sequence listing is incorporated herein by reference in its entirety.

FIELD

The present embodiments provide methods, compounds, and compositions useful for inhibiting APOL1 (apolipoprotein L, 1) expression, and in certain instances, reducing the amount of APOL1 protein in a cell or animal, which can be useful for treating, preventing, or ameliorating a disease associated with APOL1.

BACKGROUND

End-stage kidney disease (ESKD) affects over half a million individuals in the United States. In the US, the likelihood that individuals of African ancestry will develop ESKD is approximately twice that observed among any other ethnic ancestry patients (McClellan W. et al. Am. J. Kidney Dis. 1988. 12:285-290; Cowie C C. et al. N. Engl. J. Med. 1989. 321:1074-1079). There are no specific therapies for the vast majority of kidney diseases. Anti-hypertensive and anti-inflamatory treatments have been found to slow progression and reduce symptoms in some patients for some types of chronic kidney disease (CKD), but they neither result in disease resolution nor completely halt disease progression.

Recent data has suggested the association of two common variants (G1 and G2) in the last exon of APOL1 among African ancestry patients and increased risk for developing CKD (Kao W H et al. Nat. Genet. 2008. 40:1185-1192; Lipkowitz M S et al. Kidney Int. 2013. 83:114-120; Genovese G. et al. Science. 2010. 329:841-845; Tzur et al. Hum Genet. 2010; Kopp et al. *J Am Soc Nephrol*. 2011). In a 2013 study, G1 and G2 risk variants in APOL1 were associated with higher rates of ESKD and progression of CKD that were observed in African ancestry patients as compared to other ethnic ancestry groups, regardless of diabetes status (Parsa A et al. N. Engl. J. Med. 2013. 369:2183-2196). Approximately 50% of African ancestry subjects carry one risk allelle in APOL1 whilst approximately 13% of African ancestry subjects (~ five million individuals) carry two risk alleles in APOL1, a substantial fraction of which will develop APOL1-associated CKD. Studies in African ancestry subjects with two APOL1 risk alleles have demonstrated increased odds ratios for developing many forms of renal disease including but not limited to focal segmental glomerularsclerosis (FSGS) (OR=10.5), hypertension attributed ESKD (OR=7.3), HIV associated nephropathy (HIVAN) (OR=29), sickle cell nephropathy (OR=3.4) and membranous lupus nephropathy (OR=5.4) (Genovese et al. *Science*, 2010; Tzur et al. *Hum Genet*. 2010; Kopp et al. *J Am Soc Nephrol*. 2011).

SUMMARY

Certain embodiments provided herein are compounds and methods for reducing the amount or activity of APOL1 mRNA, and in certain embodiments, reducing the amount of APOL1 protein in a cell or animal. In certain embodiments, the animal has a APOL1-associated nephropathy, including for example HIV associated nephropathy, focal segmental gomerulosclerosis (FSGS), collapsing nephropathy, sickle cell nephropathy, arterionephro-sclerosis, lupus nephritis, hypertension associated nephropathy, and other forms of APOL1 associated proteinuric disease. In certain embodiments, the disease is focal segmental glomerulosclerosis (FSGS). In certain embodiments, the disease is CKD. In certain embodiments, the disease is aterionephro-sclerosis. In certain embodiments, the disease is lupus nephritis. In certain embodiments the disease is hypertension-attributed CKD. In certain embodiments, the disease is end stage renal disease (ESRD). In certain embodiments, the disease is HIV-associated nephropathy. In certain embodiments, the disease is sickle cell nephropathy. In certain embodiments, the disease is membranous lupus nephropathy.

Certain embodiments provided herein are directed to potent and tolerable compounds and compositions useful for inhibiting APOL1 expression, which can be useful for treating, preventing, ameliorating, or slowing progression of APOL1-associated nephropathy. Certain embodiments provided herein are directed to compounds and compositions that are more potent or have greater therapeutic value than compounds publicly disclosed.

DETAILED DESCRIPTION

It is to be understood that both the foregoing general description and the following detailed description are exemplary and explanatory only and are not restrictive of the embodiments, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO in the examples contained herein is independent of any modification to a sugar moiety, an internucleoside linkage, or a nucleobase. As such, compounds defined by a SEQ ID NO may comprise, independently, one or more modifications to a sugar moiety, an internucleoside linkage, or a nucleobase. Compounds described by ION/ISIS number indicate a combination of nucleobase sequence, chemical modification, and motif.

Definitions

Unless otherwise indicated, the following terms have the following meanings:

"2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (uracil).

"2'-O-methoxyethyl" (also 2'-MOE) refers to a 2'-O ($CH_2$)$_2$—$OCH_3$) in the place of the 2'-OH group of a ribosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a sugar moiety comprising at least one 2'-substituent group other than H or OH.

"3' target site" refers to the nucleotide of a target nucleic acid which is complementary to the 3'-most nucleotide of a particular compound.

"5' target site" refers to the nucleotide of a target nucleic acid which is complementary to the 5'-most nucleotide of a particular compound.

"5-methylcytosine" means a cytosine with a methyl group attached to the 5 position.

"About" means within +10% of a value. For example, if it is stated, "the compounds affected about 70% inhibition of APOL1", it is implied that APOL1 levels are inhibited within a range of 60% and 80%.

"Administration" or "administering" refers to routes of introducing a compound or composition provided herein to an individual to perform its intended function. An example of a route of administration that can be used includes, but is not limited to parenteral administration, such as subcutaneous, intravenous, or intramuscular injection or infusion.

"Administered concomitantly" or "co-administration" means administration of two or more compounds in any manner in which the pharmacological effects of both are manifest in the patient. Concomitant administration does not require that both compounds be administered in a single pharmaceutical composition, in the same dosage form, by the same route of administration, or at the same time. The effects of both compounds need not manifest themselves at the same time. The effects need only be overlapping for a period of time and need not be coextensive. Concomitant administration or co-administration encompasses administration in parallel or sequentially.

"Amelioration" refers to an improvement or lessening of at least one indicator, sign, or symptom of an associated disease, disorder, or condition. In certain embodiments, amelioration includes a delay or slowing in the progression or severity of one or more indicators of a condition or disease. The progression or severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable and/or measurable activity attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound to the target.

"Antisense compound" means a compound comprising an oligonucleotide and optionally one or more additional features, such as a conjugate group or terminal group. Examples of antisense compounds include single-stranded and double-stranded compounds, such as, oligonucleotides, ribozymes, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means an oligonucleotide having a nucleobase sequence that is complementary to a target nucleic acid or region or segment thereof. In certain embodiments, an antisense oligonucleotide is specifically hybridizable to a target nucleic acid or region or segment thereof.

"APOL1" means any nucleic acid or protein of APOL1. "APOL1 nucleic acid" means any nucleic acid encoding APOL1. For example, in certain embodiments, a APOL1 nucleic acid includes a DNA sequence encoding APOL1, an RNA sequence transcribed from DNA encoding APOL1 (including genomic DNA comprising introns and exons), and an mRNA sequence encoding APOL1. "APOL1 mRNA" means an mRNA encoding a APOL1 protein. The target may be referred to in either upper or lower case.

"APOL1 specific inhibitor" refers to any agent capable of specifically inhibiting APOL1 RNA and/or APOL1 protein expression or activity at the molecular level. For example, APOL1 specific inhibitors include nucleic acids (including antisense compounds), peptides, antibodies, small molecules, and other agents capable of inhibiting the expression of APOL1 RNA and/or APOL1 protein.

"Bicyclic nucleoside" or "BNA" means a nucleoside comprising a bicyclic sugar moiety. "Bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

"Branching group" means a group of atoms having at least 3 positions that are capable of forming covalent linkages to at least 3 groups. In certain embodiments, a branching group provides a plurality of reactive sites for connecting tethered ligands to an oligonucleotide via a conjugate linker and/or a cleavable moiety.

"Cell-targeting moiety" means a conjugate group or portion of a conjugate group that is capable of binding to a particular cell type or particular cell types.

"cEt" or "constrained ethyl" means a ribosyl bicyclic sugar moiety wherein the second ring of the bicyclic sugar is formed via a bridge connecting the 4'-carbon and the 2'-carbon, wherein the bridge has the formula: 4'-CH($CH_3$)—O-2', and wherein the methyl group of the bridge is in the S configuration.

"cEt nucleoside" means a nucleoside comprising a cEt modified sugar moiety.

"Chemical modification" in a compound describes the substitutions or changes through chemical reaction, of any of the units in the compound relative to the original state of such unit. "Modified nucleoside" means a nucleoside having, independently, a modified sugar moiety and/or modified nucleobase. "Modified oligonucleotide" means an oligonucleotide comprising at least one modified internucleoside linkage, a modified sugar, and/or a modified nucleobase.

"Chemically distinct region" refers to a region of a compound that is in some way chemically different than another region of the same compound. For example, a region having 2-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group of atoms that is cleaved under physiological conditions, for example, inside a cell, an animal, or a human.

"Complementary" in reference to an oligonucleotide means the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine ($^m$C) and guanine (G) unless otherwise specified. Complementary oligonucleotides and/or nucleic acids need not have nucleobase complementarity at each nucleoside and may include one or more nucleobase mismatches. By contrast, "fully complementary" or "100% complementary" in reference to oligonucleotides means that such oligonucleotides have nucleobase matches at each nucleoside without any nucleobase mismatches.

"Conjugate group" means a group of atoms that is attached to an oligonucleotide. Conjugate groups include a conjugate moiety and a conjugate linker that attaches the conjugate moiety to the oligonucleotide.

"Conjugate linker" means a group of atoms comprising at least one bond that connects a conjugate moiety to an oligonucleotide.

"Conjugate moiety" means a group of atoms that is attached to an oligonucleotide via a conjugate linker.

"Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

"Designing" or "Designed to" refer to the process of designing a compound that specifically hybridizes with a selected nucleic acid molecule.

"Diluent" means an ingredient in a composition that lacks pharmacological activity, but is pharmaceutically necessary or desirable. For example, the diluent in an injected composition can be a liquid, e.g. saline solution.

"Differently modified" means chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

"Dose" means a specified quantity of a compound or pharmaceutical agent provided in a single administration, or in a specified time period. In certain embodiments, a dose may be administered in two or more boluses, tablets, or injections. For example, in certain embodiments, where subcutaneous administration is desired, the desired dose may require a volume not easily accommodated by a single injection. In such embodiments, two or more injections may be used to achieve the desired dose. In certain embodiments, a dose may be administered in two or more injections to minimize injection site reaction in an individual. In other embodiments, the compound or pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Double-stranded antisense compound" means an antisense compound comprising two oligomeric compounds that are complementary to each other and form a duplex, and wherein one of the two said oligomeric compounds comprises an oligonucleotide.

"Effective amount" means the amount of compound sufficient to effectuate a desired physiological outcome in an individual in need of the compound. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to, the products of transcription and translation.

"Gapmer" means an oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Hybridization" means the annealing of oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an oligonucleotide and a nucleic acid target.

"Immediately adjacent" means there are no intervening elements between the immediately adjacent elements of the same kind (e.g. no intervening nucleobases between the immediately adjacent nucleobases).

"Individual" means a human or non-human animal selected for treatment or therapy.

"Inhibiting the expression or activity" refers to a reduction or blockade of the expression or activity relative to the expression of activity in an untreated or control sample and does not necessarily indicate a total elimination of expression or activity.

"Internucleoside linkage" means a group or bond that forms a covalent linkage between adjacent nucleosides in an oligonucleotide. "Modified internucleoside linkage" means any internucleoside linkage other than a naturally occurring, phosphate internucleoside linkage. Non-phosphate linkages are referred to herein as modified internucleoside linkages.

"Lengthened oligonucleotides" are those that have one or more additional nucleosides relative to an oligonucleotide disclosed herein, e.g. a parent oligonucleotide.

"Linked nucleosides" means adjacent nucleosides linked together by an internucleoside linkage.

"Linker-nucleoside" means a nucleoside that links an oligonucleotide to a conjugate moiety. Linker-nucleosides are located within the conjugate linker of a compound. Linker-nucleosides are not considered part of the oligonucleotide portion of a compound even if they are contiguous with the oligonucleotide.

"Mismatch" or "non-complementary" means a nucleobase of a first oligonucleotide that is not complementary to the corresponding nucleobase of a second oligonucleotide or target nucleic acid when the first and second oligonucleotides are aligned. For example, nucleobases including but not limited to a universal nucleobase, inosine, and hypoxanthine, are capable of hybridizing with at least one nucleobase but are still mismatched or non-complementary with respect to nucleobase to which it hybridized. As another example, a nucleobase of a first oligonucleotide that is not capable of hybridizing to the corresponding nucleobase of a second oligonucleotide or target nucleic acid when the first and second oligonucleotides are aligned is a mismatch or non-complementary nucleobase.

"Modulating" refers to changing or adjusting a feature in a cell, tissue, organ or organism. For example, modulating APOL1 RNA can mean to increase or decrease the level of APOL1 RNA and/or APOL1 protein in a cell, tissue, organ or organism. A "modulator" effects the change in the cell, tissue, organ or organism. For example, a APOL1 compound can be a modulator that decreases the amount of APOL1 RNA and/or APOL1 protein in a cell, tissue, organ or organism.

"MOE" means methoxyethyl.

"Monomer" refers to a single unit of an oligomer. Monomers include, but are not limited to, nucleosides and nucleotides.

"Motif" means the pattern of unmodified and/or modified sugar moieties, nucleobases, and/or internucleoside linkages, in an oligonucleotide.

"Natural" or "naturally occurring" means found in nature.

"Non-bicyclic modified sugar" or "non-bicyclic modified sugar moiety" means a modified sugar moiety that comprises a modification, such as a substituent, that does not form a bridge between two atoms of the sugar to form a second ring.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid. As used herein a "naturally occurring nucleobase" is adenine (A), thymine (T), cytosine (C), uracil (U), and guanine (G). A "modified nucleobase" is a naturally occurring nucleobase that is chemically modified. A "universal base" or "universal nucleobase" is a nucleobase other than a naturally occurring nucleobase and modified nucleobase, and is capable of pairing with any nucleobase.

"Nucleobase sequence" means the order of contiguous nucleobases in a nucleic acid or oligonucleotide independent of any sugar or internucleoside linkage.

"Nucleoside" means a compound comprising a nucleobase and a sugar moiety. The nucleobase and sugar moiety are each, independently, unmodified or modified. "Modified nucleoside" means a nucleoside comprising a modified nucleobase and/or a modified sugar moiety. Modified nucleosides include abasic nucleosides, which lack a nucleobase.

"Oligomeric compound" means a compound comprising a single oligonucleotide and optionally one or more additional features, such as a conjugate group or terminal group.

"Oligonucleotide" means a polymer of linked nucleosides each of which can be modified or unmodified, independent one from another. Unless otherwise indicated, oligonucleotides consist of 8-80 linked nucleosides. "Modified oligonucleotide" means an oligonucleotide, wherein at least one sugar, nucleobase, or internucleoside linkage is modified. "Unmodified oligonucleotide" means an oligonucleotide that does not comprise any sugar, nucleobase, or internucleoside modification.

"Parent oligonucleotide" means an oligonucleotide whose sequence is used as the basis of design for more oligonucleotides of similar sequence but with different lengths, motifs, and/or chemistries. The newly designed oligonucleotides may have the same or overlapping sequence as the parent oligonucleotide.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Pharmaceutically acceptable carrier or diluent" means any substance suitable for use in administering to an individual. For example, a pharmaceutically acceptable carrier can be a sterile aqueous solution, such as PBS or water-for-injection.

"Pharmaceutically acceptable salts" means physiologically and pharmaceutically acceptable salts of compounds, such as oligomeric compounds or oligonucleotides, i.e., salts that retain the desired biological activity of the parent compound and do not impart undesired toxicological effects thereto.

"Pharmaceutical agent" means a compound that provides a therapeutic benefit when administered to an individual.

"Pharmaceutical composition" means a mixture of substances suitable for administering to an individual. For example, a pharmaceutical composition may comprise one or more compounds or salt thereof and a sterile aqueous solution.

"Phosphorothioate linkage" means a modified phosphate linkage in which one of the non-bridging oxygen atoms is replaced with a sulfur atom. A phosphorothioate internucleoside linkage is a modified internucleoside linkage.

"Phosphorus moiety" means a group of atoms comprising a phosphorus atom. In certain embodiments, a phosphorus moiety comprises a mono-, di-, or tri-phosphate, or phosphorothioate.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound.

"Prevent" refers to delaying or forestalling the onset, development or progression of a disease, disorder, or condition for a period of time from minutes to indefinitely.

"Prodrug" means a compound in a form outside the body which, when administered to an individual, is metabolized to another form within the body or cells thereof. In certain embodiments, the metabolized form is the active, or more active, form of the compound (e.g., drug). Typically conversion of a prodrug within the body is facilitated by the action of an enzyme(s) (e.g., endogenous or viral enzyme) or chemical(s) present in cells or tissues, and/or by physiologic conditions.

"Reduce" means to bring down to a smaller extent, size, amount, or number.

"RefSeq No." is a unique combination of letters and numbers assigned to a sequence to indicate the sequence is for a particular target transcript (e.g., target gene). Such sequence and information about the target gene (collectively, the gene record) can be found in a genetic sequence database. Genetic sequence databases include the NCBI Reference Sequence database, GenBank, the European Nucleotide Archive, and the DNA Data Bank of Japan (the latter three forming the International Nucleotide Sequence Database Collaboration or INSDC).

"Region" is defined as a portion of the target nucleic acid having at least one identifiable structure, function, or characteristic.

"RNAi compound" means an antisense compound that acts, at least in part, through RISC or Ago2, but not through RNase H, to modulate a target nucleic acid and/or protein encoded by a target nucleic acid. RNAi compounds include, but are not limited to double-stranded siRNA, single-stranded RNA (ssRNA), and microRNA, including microRNA mimics.

"Segments" are defined as smaller or sub-portions of regions within a nucleic acid.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" in reference to a compound means the compound has only one oligonucleotide. "Self-complementary" means an oligonucleotide that at least partially hybridizes to itself. A compound consisting of one oligonucleotide, wherein the oligonucleotide of the compound is self-complementary, is a single-stranded compound. A single-stranded compound may be capable of binding to a complementary compound to form a duplex.

"Sites" are defined as unique nucleobase positions within a target nucleic acid.

"Specifically hybridizable" refers to an oligonucleotide having a sufficient degree of complementarity between the oligonucleotide and a target nucleic acid to induce a desired effect, while exhibiting minimal or no effects on non-target nucleic acids. In certain embodiments, specific hybridization occurs under physiological conditions.

"Specifically inhibit" with reference to a target nucleic acid means to reduce or block expression of the target nucleic acid while exhibiting fewer, minimal, or no effects on non-target nucleic acids. Reduction does not necessarily indicate a total elimination of the target nucleic acid's expression.

"Standard cell assay" means assay(s) described in the Examples and reasonable variations thereof.

"Standard in vivo experiment" means the procedure(s) described in the Example(s) and reasonable variations thereof.

"Stereorandom chiral center" in the context of a population of molecules of identical molecular formula means a chiral center having a random stereochemical configuration. For example, in a population of molecules comprising a stereorandom chiral center, the number of molecules having the(S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

"Sugar moiety" means an unmodified sugar moiety or a modified sugar moiety. "Unmodified sugar moiety" or "unmodified sugar" means a 2'-OH(H) ribosyl moiety, as found in RNA (an "unmodified RNA sugar moiety"), or a 2'-H(H) moiety, as found in DNA (an "unmodified DNA sugar moiety"). "Modified sugar moiety" or "modified sugar" means a modified furanosyl sugar moiety or a sugar surrogate.

"Modified furanosyl sugar moiety" means a furanosyl sugar comprising a non-hydrogen substituent in place of at least one hydrogen or hydroxyl of an unmodified sugar moiety. In certain embodiments, a modified furanosyl sugar moiety is a 2'-substituted sugar moiety.

Such modified furanosyl sugar moieties include bicyclic sugars and non-bicyclic sugars.

"Sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary compounds or nucleic acids.

"Synergy" or "synergize" refers to an effect of a combination that is greater than additive of the effects of each component alone at the same doses.

"Target gene" refers to a gene encoding a target.

"Targeting" means the specific hybridization of a compound to a target nucleic acid in order to induce a desired effect.

"Target nucleic acid," "target RNA," "target RNA transcript" and "nucleic acid target" all mean a nucleic acid capable of being targeted by compounds described herein.

"Target region" means a portion of a target nucleic acid to which one or more compounds is targeted.

"Target segment" means the sequence of nucleotides of a target nucleic acid to which a compound is targeted. "5' target site" refers to the 5'-most nucleotide of a target segment. "3' target site" refers to the 3'-most nucleotide of a target segment.

"Terminal group" means a chemical group or group of atoms that is covalently linked to a terminus of an oligonucleotide.

"Therapeutically effective amount" means an amount of a compound, pharmaceutical agent, or composition that provides a therapeutic benefit to an individual.

"Treat" refers to administering a compound or pharmaceutical composition to an animal in order to effect an alteration or improvement of a disease, disorder, or condition in the animal.

CERTAIN EMBODIMENTS

Certain embodiments provide methods, compounds and compositions for inhibiting APOL1 (APOL1) expression.

Certain embodiments provide compounds targeted to a APOL1 nucleic acid. In certain embodiments, the APOL1 nucleic acid has the sequence set forth in RefSeq or GENBANK Accession No. NM_003661.3 (incorporated by reference, disclosed herein as SEQ ID NO: 1), NT_011520.9 truncated from nucleotides 15986452 to 16001905 (SEQ ID NO: 2), NM_001136541.1 (SEQ ID NO: 3), NM_001136540.1 (SEQ ID NO: 4), NM_145343.2 (SEQ ID NO: 5), DC339680.1 (SEQ ID NO: 6), AK309143.1 (SEQ ID NO: 7), NT_011520.13 truncated from nucleotides 17543446 to 17543655 (SEQ ID NO: 8), or NC_000022.11 truncated from nucleotides 36250001 to 36271000 (SEQ ID NO: 9). In certain embodiments, the compound is an antisense compound or oligomeric compound. In certain embodiments, the compound is single-stranded. In certain embodiments, the compound is double-stranded.

Certain embodiments provide a compound comprising a modified oligonucleotide 8 to 80 linked nucleosides in length and having a nucleobase sequence comprising at least 8 contiguous nucleobases of any of the nucleobase sequences of SEQ ID NOs: 13-1941. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 12 to 80 linked nucleosides in length and having a nucleobase sequence comprising at least 12 contiguous nucleobases of any of the nucleobase sequences of SEQ ID NOs: 13-1941. In certain embodiments, the compound is an antisense compound or oligomeric compound. In certain embodiments, the compound is single-stranded. In certain embodiments, the compound is double-stranded. In certain embodiments, the modified oligonucleotide is 12 to 30 linked nucleosides in length. In certain embodiments, the compound comprises a modified oligonucleotide 16 linked nucleosides in length. In certain embodiments, the compound is an antisense compound or oligomeric compound.

Certain embodiments provide a compound comprising a modified oligonucleotide 16 to 30 linked nucleosides in length and having a nucleobase sequence comprising the nucleobase sequence of any one of SEQ ID NOs: 13-1941. In certain embodiments, the compound is an antisense compound or oligomeric compound. In certain embodiments, the compound is single-stranded. In certain embodiments, the compound is double-stranded.

Certain embodiments provide a compound comprising a modified oligonucleotide consisting of the nucleobase sequence of any one of SEQ ID NOs: 13-1941. In certain embodiments, the compound is an antisense compound or oligomeric compound. In certain embodiments, the compound is single-stranded. In certain embodiments, the compound is double-stranded.

In certain embodiments, compounds target nucleotides 5849-5907, 5853-5869, 5855-5873, 8145-8180, 8168-8216, 8306-8321, 8320-8338, 8723-8847, 8743-8760, 8829-8847, 8755-8840, 14342-14390, and 14342-14370 of a APOL1 nucleic acid. In certain embodiments, compounds target within nucleotides 5849-5907, 5853-5869, 5855-5873, 8145-8180, 8168-8216, 8306-8321, 8320-8338, 8723-8847, 8743-8760, 8829-8847, 8755-8840, 14342-14390, and 14342-14370 of a APOL1 nucleic acid having the nucleobase sequence of SEQ ID NO: 2. In certain embodiments, compounds have at least an 8, 9, 10, 11, 12, 13, 14, 15, or 16 contiguous nucleobase portion complementary to an equal length portion within nucleotides 5849-5907, 5853-5869, 5855-5873, 8145-8180, 8168-8216, 8306-8321, 8320-8338, 8723-8847, 8743-8760, 8829-8847, 8755-8840, 14342-14390, and 14342-14370 of a APOL1 nucleic acid having the nucleobase sequence of SEQ ID NO: 2. In certain embodiments, these compounds are antisense compounds, oligomeric compounds, or oligonucleotides.

In certain embodiments, compounds target a region of a APOL1 nucleic acid having the nucleobase sequence of SEQ ID NO: 2 within nucleobases 5849-5907, 5853-5869, 5855-5873, 8145-8180, 8168-8216, 8306-8321, 8320-8338, 8723-8847, 8743-8760, 8829-8847, 8755-8840, 14342-14390, and 14342-14370. In certain embodiments, compounds target at least an 8, 9, 10, 11, 12, 13, 14, 15, or 16 contiguous nucleobases within the aforementioned nucleobase regions. In certain embodiments, these compounds are antisense compounds, oligomeric compounds, or oligonucleotides. In certain embodiments, the modified oligonucleotide is 10 to 30 linked nucleosides in length.

In certain embodiments, a compound comprises a modified oligonucleotide 12 to 30 linked nucleosides in length and complementary within nucleotides 5854-5869, 5855-5870, 8164-8179, 8306-8321, 8321-8336, 8744-8759, 8829-

8844, or 14342-14357 of SEQ ID NO: 2. In certain embodiments, the modified oligonucleotide is 16 to 30 linked nucleosides in length.

In certain embodiments, a compound comprises a modified oligonucleotide 12 to 30 linked nucleosides in length and having a nucleobase sequence comprising at least an 8, 9, 10, 11, 12, 13, 14, 15, or 16 contiguous nucleobase portion any one of SEQ ID NOs: 1164, 13, 76, 81, 1095, 1326, 1730, and 1925. In certain embodiments, the modified oligonucleotide is 16 to 30 linked nucleosides in length.

In certain embodiments, a compound comprises a modified oligonucleotide 12 to 30 linked nucleosides in length and having a nucleobase sequence comprising any one of SEQ ID NOs: 1164, 13, 76, 81, 1095, 1326, 1730, and 1925. In certain embodiments, the modified oligonucleotide is 16 to 30 linked nucleosides in length.

In certain embodiments, a compound comprises a modified oligonucleotide having a nucleobase sequence consisting of any one of SEQ ID NOs: 1164, 13, 76, 81, 1095, 1326, 1730, and 1925.

In certain embodiments, any of the foregoing modified oligonucleotides comprises at least one modified internucleoside linkage, at least one modified sugar, and/or at least one modified nucleobase.

In certain embodiments, any of the foregoing modified oligonucleotides comprises at least one modified sugar. In certain embodiments, at least one modified sugar comprises a 2-O-methoxyethyl group. In certain embodiments, at least one modified sugar is a bicyclic sugar, such as a 4'-CH(CH3)-O-2' group, a 4'-CH2-O-2' group, or a 4-(CH2)2-O-2 group.

In certain embodiments, the modified oligonucleotide comprises at least one modified internucleoside linkage, such as a phosphorothioate internucleoside linkage.

In certain embodiments, any of the foregoing modified oligonucleotides comprises at least one modified nucleobase, such as 5-methylcytosine.

In certain embodiments, any of the foregoing modified oligonucleotides comprises:
  a gap segment consisting of linked deoxynucleosides;
  a 5' wing segment consisting of linked nucleosides; and
  a 3' wing segment consisting of linked nucleosides:
  wherein the gap segment is positioned between the 5' wing segment and the 3' wing segment and wherein each nucleoside of each wing segment comprises a modified sugar. In certain embodiments, the modified oligonucleotide is 16 to 80 linked nucleosides in length having a nucleobase sequence comprising the sequence recited in any one of SEQ ID NOs: 1164, 13, 76, 81, 1095, 1326, 1730, and 1925. In certain embodiments, the modified oligonucleotide is 16 to 30 linked nucleosides in length having a nucleobase sequence comprising the sequence recited in any one of SEQ ID NOs: 1164, 13, 76, 81, 1095, 1326, 1730, and 1925. In certain embodiments, the modified oligonucleotide is 16 linked nucleosides in length having a nucleobase sequence consisting of the sequence recited in any one of SEQ ID NOs: 1164, 13, 76, 81, 1095, 1326, 1730, and 1925.

In certain embodiments, a compound comprises or consists of a modified oligonucleotide 16-30 linked nucleobases in length having a nucleobase sequence comprising the sequence recited in any one of SEQ ID NOs: 13, 1095, 1730, 76, 1326, and 81, wherein the modified oligonucleotide comprises a gap segment consisting of ten linked deoxynucleosides;
  a 5' wing segment consisting of three linked nucleosides; and
  a 3' wing segment consisting of three linked nucleosides;
  wherein the gap segment is positioned between the 5' wing segment and the 3' wing segment,
  wherein the 5' and 3' wing segments comprise a cEt nucleoside; wherein each internucleoside linkage is a phosphorothioate linkage; and wherein each cytosine is a 5-methylcytosine. In certain embodiments, the modified oligonucleotide is 16-80 linked nucleosides in length. In certain embodiments, the modified oligonucleotide is 16-30 linked nucleosides in length.

In certain embodiments, a compound comprises or consists of a modified oligonucleotide 16-30 linked nucleobases in length having a nucleobase sequence comprising or consisting of the sequence recited in any one of SEQ ID NOs: 1164 and 1925, wherein the modified oligonucleotide comprises:
  a gap segment consisting of nine linked deoxynucleosides;
  a 5' wing segment consisting of three linked nucleoside; and
  a 3' wing segment consisting of four linked nucleosides;
  wherein the gap segment is positioned between the 5' wing segment and the 3' wing segment: wherein the 5' wing segment comprises cEt nucleosides: wherein the 3' wing segment comprises a cEt nucleoside, a a cEt nucleoside, a cEt nucleoside, and 2'-O-methoxyethyl nucleoside in the 5' to 3' direction: wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-30 linked nucleobases in length having a nucleobase sequence comprising or consisting of the sequence recited in SEQ ID NO: 1164, wherein the modified oligonucleotide comprises:
  a gap segment consisting of nine linked deoxynucleosides;
  a 5' wing segment consisting of three linked nucleoside; and
  a 3' wing segment consisting of four linked nucleosides;
  wherein the gap segment is positioned between the 5' wing segment and the 3' wing segment: wherein the 5' wing segment comprises cEt nucleosides; wherein the 3' wing segment comprises a cEt nucleoside, a a cEt nucleoside, a cEt nucleoside, and 2'-O-methoxyethyl nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of the following formula Tks Tks Tks Tds Gds Tds Ads Ads Gds Tds Gds mCds Aks Aks mCks mCe (SEQ ID NO: 1950), wherein, A=an adenine, mC=a 5-methylcytosine G=a guanine, T=a thymine, e=a 2-O-methoxyethyl modified nucleoside, k=a cEt modified nucleoside, d=a 2-deoxynucleoside, and s=a phosphorothioate internucleoside linkage.

In certain embodiments, a compound comprises or consists of ION 972190 or salt thereof, having the following chemical structure (SEQ ID NO: 1950):

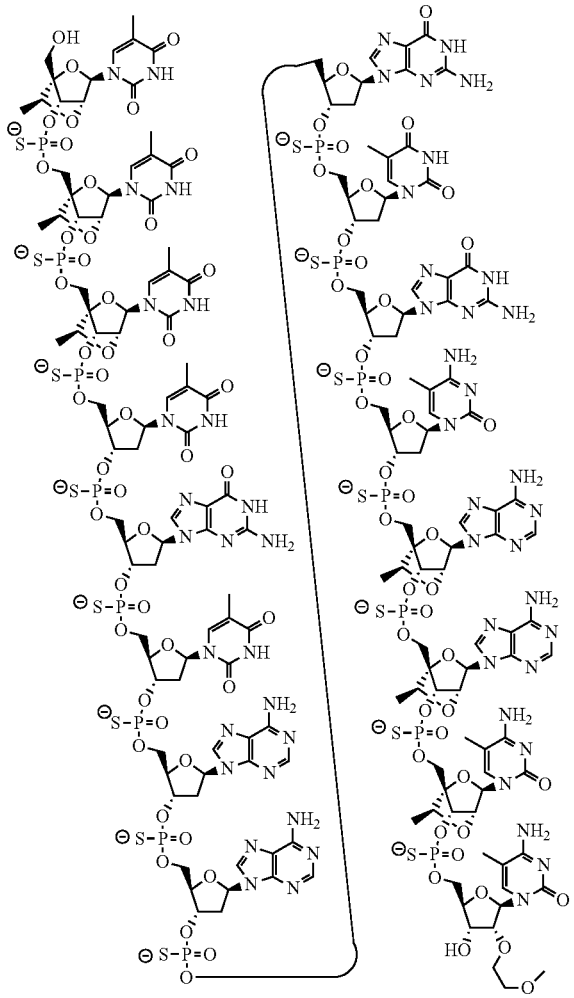

In certain embodiments, a compound comprises or consists of the sodium salt of ION 972190, having the following chemical structure (SEQ ID NO: 1950):

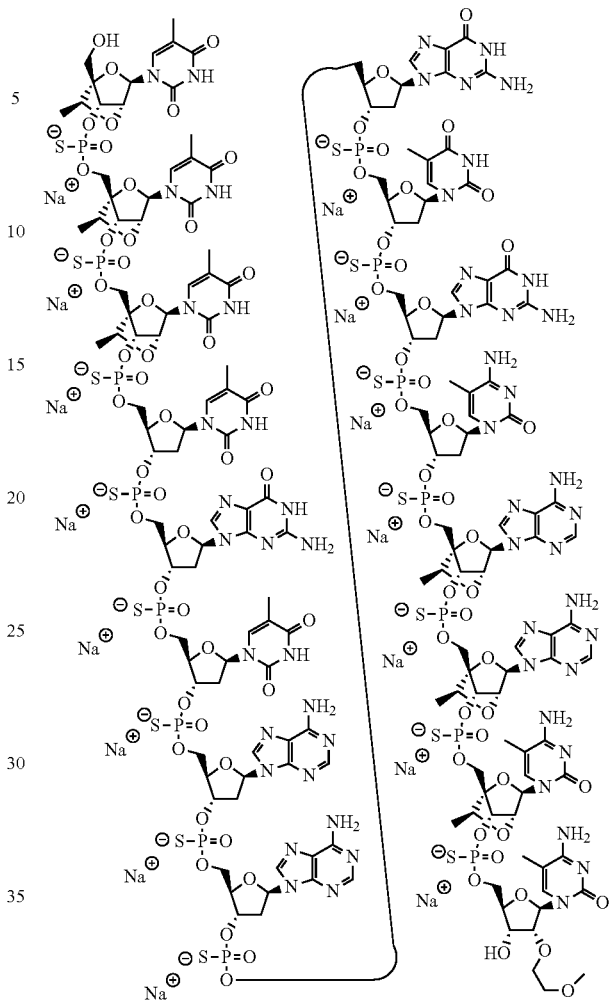

In any of the foregoing embodiments, the compound or oligonucleotide can be at least 85%, at least 90%, at least 95%, at least 98%, at least 99%, or 100% complementary to a nucleic acid encoding APOL1.

In any of the foregoing embodiments, the compound can be single-stranded. In certain embodiments, the compound comprises deoxyribonucleotides. In certain embodiments, the compound is double-stranded. In certain embodiments, the compound is double-stranded and comprises ribonucleotides. In any of the foregoing embodiments, the compound can be an antisense compound or oligomeric compound.

In any of the foregoing embodiments, the compound can be 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides in length. In certain embodiments, the compound comprises or consists of an oligonucleotide.

In certain embodiments, compounds or compositions provided herein comprise a pharmaceutically acceptable salt of the modified oligonucleotide. In certain embodiments, the salt is a sodium salt. In certain embodiments, the salt is a potassium salt.

In certain embodiments, the compounds or compositions as described herein are highly tolerable as demonstrated by having at least one of an increase an alanine transaminase (ALT) or aspartate transaminase (AST) value of no more than 4 fold, 3 fold, or 2 fold over saline treated animals or an increase in liver, spleen, or kidney weight of no more than 30%, 20%, 15%, 12%, 10%, 5%, or 2% compared to control treated animals. In certain embodiments, the compounds or compositions as described herein are highly tolerable as demonstrated by having no increase of ALT or AST over control treated animals. In certain embodiments, the compounds or compositions as described herein are highly tolerable as demonstrated by having no increase in liver, spleen, or kidney weight over control animals.

Certain embodiments provide a composition comprising the compound of any of the aforementioned embodiments or any pharmaceutically acceptable salt thereof and at least one of a pharmaceutically acceptable carrier or diluent. In certain embodiments, the composition has a viscosity less than about 40 centipoise (cP), less than about 30 centipose (cP), less than about 20 centipose (cP), less than about 15 centipose (cP), or less than about 10 centipose (cP). In certain embodiments, the composition having any of the aforementioned viscosities comprises a compound provided herein at a concentration of about 100 mg/mL, about 125 mg/mL, about 150 mg/mL, about 175 mg/mL, about 200 mg/mL, about 225 mg/mL, about 250 mg/mL, about 275 mg/mL, or about 300 mg/mL. In certain embodiments, the composition having any of the aforementioned viscosities and/or compound concentrations has a temperature of room temperature or about 20° C., about 21° C., about 22° C., about 23° C., about 24° C., about 25° C., about 26° C., about 27° C., about 28° C., about 29° C., or about 30° C.

Certain Indications

Certain embodiments provided herein relate to methods of inhibiting APOL1 expression, which can be useful for treating, preventing, or ameliorating a disease associated with APOL1 in an individual, by administration of a compound that targets APOL1. In certain embodiments, the compound can be a APOL1 specific inhibitor. In certain embodiments, the compound can be an antisense compound, oligomeric compound, or oligonucleotide targeted to APOL1.

Examples of diseases associated with APOL1 treatable, preventable, and/or ameliorable with the methods provided herein include APOL-1-associated nephropathy, focal segmental glomerulosclerosis (FSGS), collapsing nephropathy, CKD, hypertension attributed nephropathy, HIV-associated nephropathy, sickle cell nephropathy, ESKD, glomerular damage, ESRD, arterionephro-sclerosis, lupus nephritis, and other forms of APOL1 associated proteinuric disease.

In certain embodiments, a method of treating, preventing, or ameliorating a disease associated with APOL1 in an individual comprises administering to the individual a compound comprising a APOL1 specific inhibitor, thereby treating, preventing, or ameliorating the disease. In certain embodiments, the individual is identified as having or at risk of having a disease associated with APOL1. In certain embodiments, the disease is a APOL1-associated nephropathy. In certain embodiments, the APOL1-associated nephropathy is one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, and other forms of APOL1-associated proteinuric disease. In certain embodiments, the compound comprises an antisense compound targeted to APOL1. In certain embodiments, the compound comprises an oligonucleotide targeted to APOL1. In certain embodiments, a compound comprises a modified oligonucleotide 16 to 30 linked nucleosides in length and having a nucleobase sequence comprising at least 8 contiguous nucleobases of any of the nucleobase sequences of SEQ ID NOs: 13-1941. In certain embodiments, a compound comprises a modified oligonucleotide 16 to 30 linked nucleosides in length and having a nucleobase sequence comprising the nucleobase sequence of any one of SEQ ID NOs: 13-1941. In certain embodiments, a compound comprises a modified oligonucleotide consisting of the nucleobase sequence of any one of SEQ ID NOs: 13-1941. In certain embodiments, a compound comprises a modified oligonucleotide 16 to 30 linked nucleosides in length having a nucleobase sequence comprising any one of SEQ ID NOs: 1164, 13, 76, 81, 1095, 1326, 1730, and 1925. In certain embodiments, a compound comprises a modified oligonucleotide having a nucleobase sequence consisting of any one of SEQ ID NOs: 1164, 13, 76, 81, 1095, 1326, 1730, and 1925. In certain embodiments, the compound is ION #793406, 904763, 905469, 905505, 905634, 905665, 972190, and 972163. In any of the foregoing embodiments, the compound can be single-stranded or double-stranded. In any of the foregoing embodiments, the compound can be an antisense compound or oligomeric compound.

In certain embodiments, the compound is administered to the individual parenterally. In certain embodiments, administering the compound improves, preserves, or prevents edema, proteinuria, albuminuria, GFR decline, high lipid levels, high cholesterol levels, nephrotic syndrome, high blood pressure or hypertension, kidney damage, glomerular damage, and kidney failure.

In certain embodiments, a method of treating, preventing, or ameliorating edema, proteinuria, albuminuria, GFR decline, high lipid levels, high cholesterol levels, nephrotic syndrome, high blood pressure or hypertension, kidney damage, glomerular damage, and kidney failure comprises administering to the individual a compound comprising a APOL1 specific inhibitor, thereby treating, preventing, or ameliorating edema, proteinuria, albuminuria, GFR decline, high lipid levels, high cholesterol levels, nephrotic syndrome, high blood pressure or hypertension, kidney damage, glomerular damage, and kidney failure. In certain embodiments, the compound comprises an antisense compound targeted to APOL1. In certain embodiments, the compound comprises an oligonucleotide targeted to APOL1. In certain embodiments, a compound comprises a modified oligonucleotide 16 to 30 linked nucleosides in length and having a nucleobase sequence comprising at least 8 contiguous nucleobases of any of the nucleobase sequences of SEQ ID NOs: 13-1941. In certain embodiments, a compound comprises a modified oligonucleotide 16 to 30 linked nucleosides in length and having a nucleobase sequence comprising the nucleobase sequence of any one of SEQ ID NOs: 13-1941. In certain embodiments, a compound comprises a modified oligonucleotide consisting of the nucleobase sequence of any one of SEQ ID NOs: 13-1941. In certain embodiments, a compound comprises a modified oligonucleotide 16 to 30 linked nucleosides in length having a nucleobase sequence comprising any one of SEQ ID NOs: 1164, 13, 76, 81, 1095, 1326, 1730, and 1925. In certain embodiments, a compound comprises a modified oligonucleotide having a nucleobase sequence consisting of any one of SEQ ID NOs: 1164, 13, 76, 81, 1095, 1326, 1730, and 1925. In certain embodiments, the compound is ION #793406, 904763, 905469, 905505, 905634, 905665, 972190, and 972163. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound improves, preserves, or prevents edema, proteinuria, albuminuria, GFR decline, high lipid levels, high cholesterol levels, nephrotic syndrome, high blood pressure or hypertension, kidney damage, glomerular damage, and kidney failure. In certain embodiments, the individual is identified as having or at risk of having a disease associated with APOL1.

In certain embodiments, a method of inhibiting expression of APOL1 in an individual having, or at risk of having, a disease associated with APOL1 comprises administering to the individual a compound comprising a APOL1 specific inhibitor, thereby inhibiting expression of APOL1 in the individual. In certain embodiments, administering the compound inhibits expression of APOL1 in the kidney. In certain embodiments, the disease is a APOL1-associated nephropathy. In certain embodiments, the APOL1-associated nephropathy is one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, and other forms of APOL1-associated proteinuric disease. In certain embodiments, the individual has, or is at risk of having edema, proteinuria, albuminuria, GFR decline, high lipid levels, high cholesterol levels, nephrotic syndrome, high blood pressure or hypertension, kidney damage, glomerular damage, or kidney failure, or a combination of these symptoms. In certain embodiments, the compound comprises an antisense compound targeted to APOL1. In certain embodiments, the compound comprises an oligonucleotide targeted to APOL1. In certain embodiments, the compound comprises an oligonucleotide targeted to APOL1. In certain embodiments, a compound comprises a modified oligonucleotide 16 to 30 linked nucleosides in length and having a nucleobase sequence comprising at least 8 contiguous nucleobases of any of the nucleobase sequences of SEQ ID NOs: 13-1941. In certain embodiments, a compound comprises a modified oligonucleotide 16 to 30 linked nucleosides in length and having a nucleobase sequence comprising the nucleobase sequence of any one of SEQ ID NOs: 13-1941. In certain embodiments, a compound comprises a modified oligonucleotide consisting of the nucleobase sequence of any one of SEQ ID NOs: 13-1941. In certain embodiments, a compound comprises a modified oligonucleotide 16 to 30 linked nucleosides in length having a nucleobase sequence comprising any one of SEQ ID NOs: 1164, 13, 76, 81, 1095, 1326, 1730, and 1925. In certain embodiments, a compound comprises a modified oligonucleotide having a nucleobase sequence consisting of any one of SEQ ID NOs: 1164, 13, 76, 81, 1095, 1326, 1730, and 1925. In certain embodiments, the compound is ION #793406, 904763, 905469, 905505, 905634, 905665, 972190, and 972163. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound improves, preserves, or prevents edema, proteinuria, albuminuria, GFR decline, high lipid levels, high cholesterol levels, nephrotic syndrome, high blood pressure or hypertension, kidney damage, glomerular damage, and kidney failure.

In certain embodiments, a method of inhibiting expression of APOL1 in a cell comprises contacting the cell with a compound comprising a APOL1 specific inhibitor, thereby inhibiting expression of APOL1 in the cell. In certain embodiments, the cell is a glomerulus. In certain embodiments, the cell is in the kidney. In certain embodiments, the cell is in the kidney of an individual who has, or is at risk of having an APOL1-associated nephropathy. In certain embodiments, the APOL1-associated nephropathy is one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, and other forms of APOL1-associated proteinuric disease. In certain embodiments, the compound comprises an antisense compound targeted to APOL1. In certain embodiments, the compound comprises an oligonucleotide targeted to APOL1. In certain embodiments, a compound comprises a modified oligonucleotide 16 to 30 linked nucleosides in length and having a nucleobase sequence comprising at least 8 contiguous nucleobases of any of the nucleobase sequences of SEQ ID NOs: 13-1941. In certain embodiments, a compound comprises a modified oligonucleotide 16 to 30 linked nucleosides in length and having a nucleobase sequence comprising the nucleobase sequence of any one of SEQ ID NOs: 13-1941. In certain embodiments, a compound comprises a modified oligonucleotide consisting of the nucleobase sequence of any one of SEQ ID NOs: 13-1941. In certain embodiments, a compound comprises a modified oligonucleotide 16 to 30 linked nucleosides in length having a nucleobase sequence comprising any one of SEQ ID NOs: 1164, 13, 76, 81, 1095, 1326, 1730, and 1925. In certain embodiments, a compound comprises a modified oligonucleotide having a nucleobase sequence consisting of any one of SEQ ID NOs: 1164, 13, 76, 81, 1095, 1326, 1730, and 1925. In certain embodiments, the compound is ION #793406, 904763, 905469, 905505, 905634, 905665, 972190, and 972163. In any of the foregoing embodiments, the compound can be single-stranded or double-stranded. In any of the foregoing embodiments, the compound can be an antisense compound or oligomeric compound.

In certain embodiments, a method of reducing or inhibiting edema, proteinuria, albuminuria, GFR decline, high lipid levels, high cholesterol levels, nephrotic syndrome, high blood pressure or hypertension, kidney damage, glomerular damage, or kidney failure in the kidney of an individual having, or at risk of having, a disease associated with APOL1 comprises administering to the individual a compound comprising a APOL1 specific inhibitor, thereby reducing or inhibiting edema, proteinuria, GFR decline, high lipid levels, high cholesterol levels, nephrotic syndrome, high blood pressure or hypertension, kidney damage, glomerular damage, or kidney failure in the individual. In certain embodiments, the individual has, or is at risk of having, an APOL1-associated nephropathy. In certain embodiments, the APOL1-associated nephropathy is one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, and other forms of APOL1-associated proteinuric disease. In certain embodiments, the compound comprises an antisense compound targeted to APOL1. In certain embodiments, the compound comprises an oligonucleotide targeted to APOL1. In certain embodiments, the compound comprises an antisense compound targeted to APOL1. In certain embodiments, the compound comprises an oligonucleotide targeted to APOL1. In certain embodiments, a compound comprises a modified oligonucleotide 16 to 30 linked nucleosides in length and having a nucleobase sequence comprising at least 8 contiguous nucleobases of any of the nucleobase sequences of SEQ ID NOs: 13-1941. In certain embodiments, a compound comprises a modified oligonucleotide 16 to 30 linked nucleosides in length and having a nucleobase sequence comprising the nucleobase sequence of any one of SEQ ID NOs: 13-1941. In certain embodiments, a compound comprises a modified oligonucleotide consisting of the nucleobase sequence of any one of SEQ ID NOs: 13-1941. In certain embodiments, a compound comprises a modified oligonucleotide 16 to 30 linked nucleosides in length having a nucleobase sequence comprising any one of SEQ ID NOs: 1164, 13, 76, 81, 1095, 1326, 1730, and 1925. In certain embodiments, a compound comprises a modified oligonucleotide having a nucleobase sequence consisting of any one of SEQ ID NOs: 1164, 13, 76, 81, 1095, 1326, 1730, and 1925. In certain embodiments, the compound is ION #793406, 904763, 905469, 905505, 905634, 905665, 972190, and 972163. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, the individual is identified as having or at risk of having a disease associated with APOL1.

Certain embodiments are drawn to a compound comprising a APOL1 specific inhibitor for use in treating a disease associated with APOL1. In certain embodiments, the disease is focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, or other forms of APOL1-associated proteinuric disease. In certain embodiments, the compound comprises an antisense compound targeted to APOL1. In certain embodiments, the compound comprises an oligonucleotide targeted to APOL1. In certain embodiments, a compound comprises a modified oligonucleotide 16 to 30 linked nucleosides in length and having a nucleobase sequence comprising at least 8 contiguous nucleobases of any of the nucleobase sequences of SEQ ID NOs: 13-1941. In certain embodiments, a compound comprises a modified oligonucleotide 16 to 30 linked nucleosides in length and having a nucleobase sequence comprising the nucleobase sequence of any one of SEQ ID NOs: 13-1941. In certain embodiments, a compound comprises a modified oligonucleotide consisting of the nucleobase sequence of any one of SEQ ID NOs: 13-1941. In certain embodiments, a compound comprises a modified oligonucleotide 16 to 30 linked nucleosides in length having a nucleobase sequence comprising any one of SEQ ID NOs: 1164, 13, 76, 81, 1095, 1326, 1730, and 1925. In certain embodiments, a compound comprises a modified oligonucleotide having a nucleobase sequence consisting of any one of SEQ ID NOs: 1164, 13, 76, 81, 1095, 1326, 1730, and 1925. In certain embodiments, the compound is ION #793406, 904763, 905469, 905505, 905634, 905665, 972190, and 972163. In any of the foregoing embodiments, the compound can be single-stranded or double-stranded. In any of the foregoing embodiments, the compound can be an antisense compound or oligomeric compound. In certain embodiments, the compound is administered to the individual parenterally.

Certain embodiments are drawn to a compound comprising a APOL1 specific inhibitor for use in reducing or inhibiting edema, proteinuria, albuminuria, GFR decline, high lipid levels, high cholesterol levels, nephrotic syndrome, high blood pressure or hypertension, kidney damage, glomerular damage, or kidney failure in an individual having or at risk of having an APOL1-associated nephropathy. In certain embodiments, the APOL1-associated nephropathy is one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, and other forms of APOL1-associated proteinuric disease. In certain embodiments, the compound comprises an antisense compound targeted to APOL1. In certain embodiments, the compound comprises an oligonucleotide targeted to APOL1. In certain embodiments, a compound comprises a modified oligonucleotide 16 to 30 linked nucleosides in length and having a nucleobase sequence comprising at least 8 contiguous nucleobases of any of the nucleobase sequences of SEQ ID NOs: 13-1941. In certain embodiments, a compound comprises a modified oligonucleotide 16 to 30 linked nucleosides in length and having a nucleobase sequence comprising the nucleobase sequence of any one of SEQ ID NOs: 13-1941. In certain embodiments, a compound comprises a modified oligonucleotide consisting of the nucleobase sequence of any one of SEQ ID NOs: 13-1941. In certain embodiments, a compound comprises a modified oligonucleotide 16 to 30 linked nucleosides in length having a nucleobase sequence comprising any one of SEQ ID NOs: 1164, 13, 76, 81, 1095, 1326, 1730, and 1925. In certain embodiments, a compound comprises a modified oligonucleotide having a nucleobase sequence consisting of any one of SEQ ID NOs: 1164, 13, 76, 81, 1095, 1326, 1730, and 1925. In certain embodiments, the compound is ION #793406, 904763, 905469, 905505, 905634, 905665, 972190, and 972163. In any of the foregoing embodiments, the compound can be single-stranded or double-stranded. In any of the foregoing embodiments, the compound can be an antisense compound or oligomeric compound.

Certain embodiments are drawn to use of a compound comprising a APOL1 specific inhibitor for the manufacture or preparation of a medicament for treating a disease associated with APOL1. Certain embodiments are drawn to use of a compound comprising a APOL1 specific inhibitor for the preparation of a medicament for treating a disease associated with APOL1. In certain embodiments, the disease is a APOL1-associated nephropathy. In certain embodiments, the disease is one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, and other forms of APOL1-associated proteinuric disease. In certain embodiments, the compound comprises an antisense compound targeted to APOL1. In certain embodiments, the compound comprises an oligonucleotide targeted to APOL1. In certain embodiments, the compound comprises an antisense compound targeted to APOL1. In certain embodiments, the compound comprises an oligonucleotide targeted to APOL1. In certain embodiments, a compound comprises a modified oligonucleotide 16 to 30 linked nucleosides in length and having a nucleobase sequence comprising at least 8 contiguous nucleobases of any of the nucleobase sequences of SEQ ID NOs: 13-1941. In certain embodiments, a compound comprises a modified oligonucleotide 16 to 30 linked nucleosides in length and having a nucleobase sequence comprising the nucleobase sequence of any one of SEQ ID NOs: 13-1941. In certain embodiments, a compound comprises a modified oligonucleotide consisting of the nucleobase sequence of any one of SEQ ID NOs: 13-1941. In certain embodiments, a compound comprises a modified oligonucleotide 16 to 30 linked nucleosides in length having a nucleobase sequence comprising any one of SEQ ID NOs: 1164, 13, 76, 81, 1095, 1326, 1730, and 1925. In certain embodiments, a compound comprises a modified oligonucleotide having a nucleobase sequence consisting of any one of SEQ ID NOs: 1164, 13, 76, 81, 1095, 1326, 1730, and 1925. In certain embodiments, the compound is ION #793406, 904763, 905469, 905505, 905634, 905665, 972190, and 972163. In any of the foregoing embodiments, the compound can be single-stranded or double-stranded. In any of the foregoing embodiments, the compound can be an antisense compound or oligomeric compound.

Certain embodiments are drawn to use of a compound comprising a APOL1 specific inhibitor for the manufacture or preparation of a medicament for reducing or inhibiting edema, proteinuria, albuminuria, GFR decline, high lipid levels, high cholesterol levels, nephrotic syndrome, high blood pressure or hypertension, kidney damage, glomerular damage, or kidney failure in an individual having or at risk of having a APOL1-associated nephropathy associated with APOL1. In certain embodiments, the APOL1-associated nephropathy is one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, and other forms of APOL1-associated proteinuric disease. Certain embodiments are drawn to use of a compound comprising a APOL1 specific inhibitor for the preparation of a medicament for treating a disease associated with APOL1. In certain embodiments, the disease is one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, and other forms of APOL1-associated proteinuric disease. In certain embodiments, the compound comprises an antisense compound targeted to APOL1. In certain embodiments, the compound comprises an oligonucleotide targeted to APOL1. In certain embodiments, a compound comprises a modified oligonucleotide 16 to 30 linked nucleosides in length and having a nucleobase sequence comprising at least 8 contiguous nucleobases of any of the nucleobase sequences of SEQ ID NOs: 13-1941. In certain embodiments, a compound comprises a modified oligonucleotide 16 to 30 linked nucleosides in length and having a nucleobase sequence comprising the nucleobase sequence of any one of SEQ ID NOs: 13-1941. In certain embodiments, a compound comprises a modified oligonucleotide consisting of the nucleobase sequence of any one of SEQ ID NOs: 13-1941. In certain embodiments, a compound comprises a modified oligonucleotide 16 to 30 linked nucleosides in length having a nucleobase sequence comprising any one of SEQ ID NOs: 1164, 13, 76, 81, 1095, 1326, 1730, and 1925. In certain embodiments, a compound comprises a modified oligonucleotide having a nucleobase sequence consisting of any one of SEQ ID NOs: 1164, 13, 76, 81, 1095, 1326, 1730, and 1925. In certain embodiments, the compound is ION #793406, 904763, 905469, 905505, 905634, 905665, 972190, and 972163. In any of the foregoing embodiments, the compound can be single-stranded or double-stranded. In any of the foregoing embodiments, the compound can be an antisense compound or oligomeric compound.

In any of the foregoing methods or uses, the compound can be targeted to APOL1. In certain embodiments, the compound comprises or consists of a modified oligonucleotide, for example a modified oligonucleotide 8 to 80 linked nucleosides in length, 10 to 30 linked nucleosides in length, 12 to 30 linked nucleosides in length, or 16 linked nucleosides in length. In certain embodiments, the modified oligonucleotide is at least 80%, 85%, 90%, 95% or 100% complementary to any of the nucleobase sequences recited in SEQ ID NOs: 1-9. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked deoxynucleosides: a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing embodiments, the modified oligonucleotide is 12 to 30, 15 to 30, 15 to 25, 15 to 24, 16 to 24, 17 to 24, 18 to 24, 19 to 24, 20 to 24, 19 to 22, 20 to 22, 16 to 20, or 17 or 20 linked nucleosides in length. In certain embodiments, the modified oligonucleotide is at least 80%, 85%, 90%, 95% or 100% complementary to any of the nucleobase sequences recited in SEQ ID NOs: 1-9. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked 2-deoxynucleosides: a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing methods or uses, the compound comprises or consists of a modified oligonucleotide 16 to 30 linked nucleosides in length and having a nucleobase sequence comprising any one of SEQ ID NOs: 13-1941, wherein the modified oligonucleotide comprises:
   a gap segment consisting of linked 2'-deoxynucleosides;
   a 5' wing segment consisting of linked nucleosides; and
   a 3' wing segment consisting of linked nucleosides;
wherein the gap segment is positioned between the 5' wing segment and the 3' wing segment and wherein each nucleoside of each wing segment comprises a modified sugar.

In any of the foregoing methods or uses, the compound comprises or consists of a modified oligonucleotide 16-30 linked nucleobases in length having a nucleobase sequence comprising the sequence recited in any one of SEQ ID NOs: 13, 1095, 1730, 76, 1326, and 81, wherein the modified oligonucleotide comprises
   a gap segment consisting of ten linked deoxynucleosides;
   a 5' wing segment consisting of three linked nucleosides; and
   a 3' wing segment consisting of three linked nucleosides;
wherein the gap segment is positioned between the 5' wing segment and the 3' wing segment, wherein the 5' and 3' wing segments comprise a cEt nucleoside: wherein each internucleoside linkage is a phosphorothioate linkage; and wherein each cytosine is a 5-methylcytosine. In certain embodiments, the modified oligonucleotide is 16-30 linked nucleosides in length.

In any of the foregoing methods or uses, the compound comprises or consists of a modified oligonucleotide 16-30 linked nucleobases in length having a nucleobase sequence comprising or consisting of the sequence recited in any one of SEQ ID NOs: 1164 and 1925, wherein the modified oligonucleotide comprises:

a gap segment consisting of nine linked deoxynucleosides;

a 5' wing segment consisting of three linked nucleoside; and a 3' wing segment consisting of four linked nucleosides;

wherein the gap segment is positioned between the 5' wing segment and the 3' wing segment: wherein the 5' wing segment comprises a cEt nucleosides: wherein the 3' wing segment comprises a cEt nucleoside, a a cEt nucleoside, a cEt nucleoside, and 2'-O-methoxyethyl nucleoside in the 5' to 3' direction: wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In any of the foregoing methods or uses, the compound comprises or consists of ION 972190 or salt thereof, having the following chemical structure (SEQ ID NO: 1950):

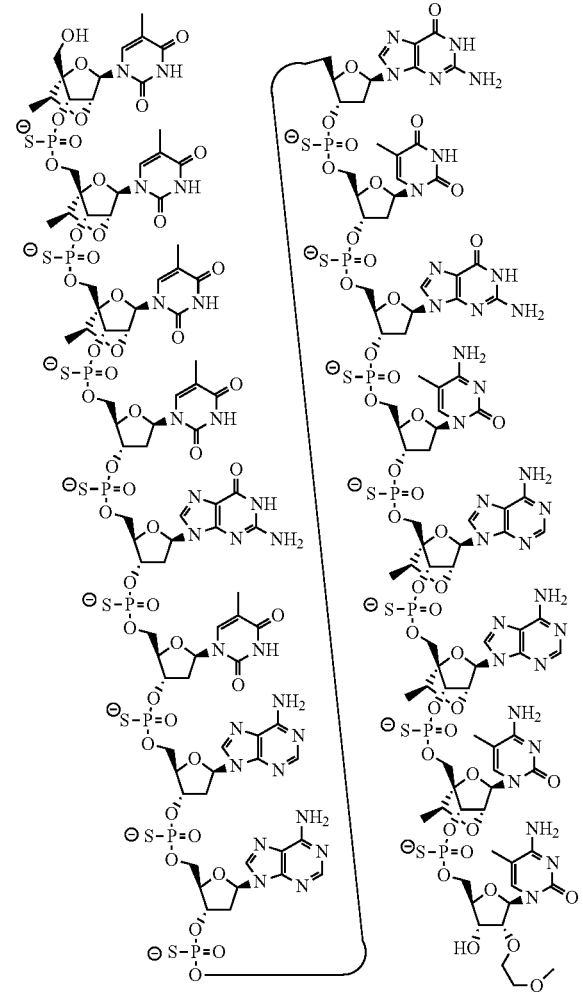

In any of the foregoing methods or uses, the compound comprises or consists of the sodium salt of ION 972190, having the following chemical structure (SEQ ID NO: 1950):

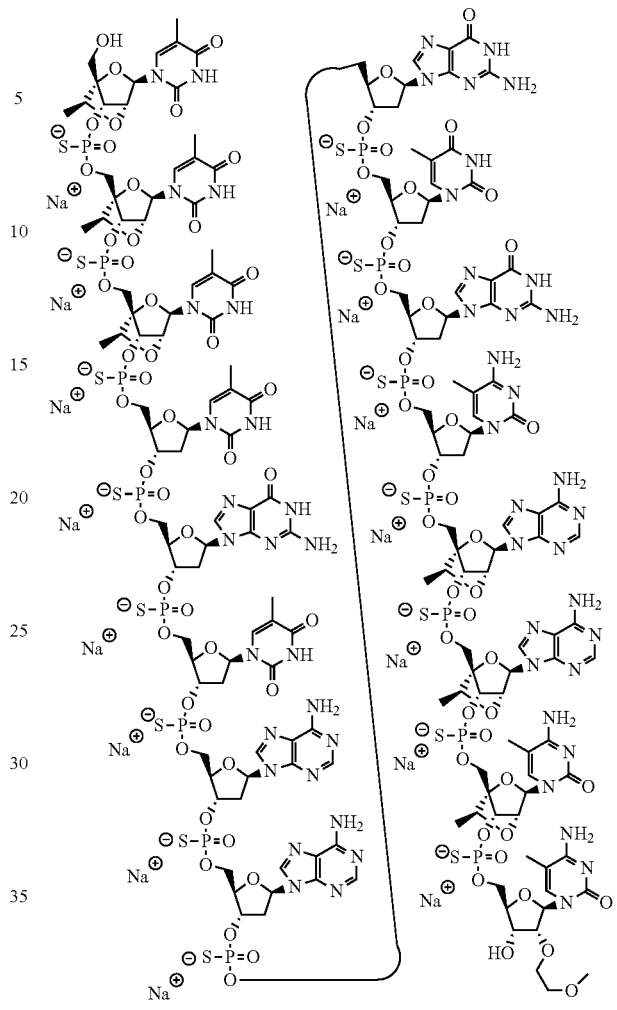

In any of the foregoing methods or uses, the compound can be administered parenterally. For example, in certain embodiments the compound can be administered through injection or infusion. Parenteral administration includes subcutaneous administration, intravenous administration, intramuscular administration, intraarterial administration, intraperitoneal administration, or intracranial administration, e.g. intrathecal or intracerebroventricular administration.

Certain Compounds

In certain embodiments, compounds described herein can be antisense compounds. In certain embodiments, the antisense compound comprises or consists of an oligomeric compound. In certain embodiments, the oligomeric compound comprises a modified oligonucleotide. In certain embodiments, the modified oligonucleotide has a nucleobase sequence complementary to that of a target nucleic acid.

In certain embodiments, a compound described herein comprises or consists of a modified oligonucleotide. In certain embodiments, the modified oligonucleotide has a nucleobase sequence complementary to that of a target nucleic acid.

In certain embodiments, a compound or antisense compound is single-stranded. Such a single-stranded compound or antisense compound comprises or consists of an oligomeric compound. In certain embodiments, such an oligomeric compound comprises or consists of an oligonucleotide and optionally a conjugate group. In certain embodiments, the oligonucleotide is an antisense oligonucleotide. In certain embodiments, the oligonucleotide is modified. In certain embodiments, the oligonucleotide of a single-stranded antisense compound or oligomeric compound comprises a self-complementary nucleobase sequence.

In certain embodiments, compounds are double-stranded. Such double-stranded compounds comprise a first modified oligonucleotide having a region complementary to a target nucleic acid and a second modified oligonucleotide having a region complementary to the first modified oligonucleotide. In certain embodiments, the modified oligonucleotide is an RNA oligonucleotide. In such embodiments, the thymine nucleobase in the modified oligonucleotide is replaced by a uracil nucleobase. In certain embodiments, compound comprises a conjugate group. In certain embodiments, one of the modified oligonucleotides is conjugated. In certain embodiments, both the modified oligonucleotides are conjugated. In certain embodiments, the first modified oligonucleotide is conjugated. In certain embodiments, the second modified oligonucleotide is conjugated. In certain embodiments, the first modified oligonucleotide is 12-30 linked nucleosides in length and the second modified oligonucleotide is 12-30 linked nucleosides in length. In certain embodiments, one of the modified oligonucleotides has a nucleobase sequence comprising at least 8 contiguous nucleobases of any of SEQ ID NOs: 13-1941.

In certain embodiments, antisense compounds are double-stranded. Such double-stranded antisense compounds comprise a first oligomeric compound having a region complementary to a target nucleic acid and a second oligomeric compound having a region complementary to the first oligomeric compound. The first oligomeric compound of such double stranded antisense compounds typically comprises or consists of a modified oligonucleotide and optionally a conjugate group. The oligonucleotide of the second oligomeric compound of such double-stranded antisense compound may be modified or unmodified. Either or both oligomeric compounds of a double-stranded antisense compound may comprise a conjugate group. The oligomeric compounds of double-stranded antisense compounds may include non-complementary overhanging nucleosides.

Examples of single-stranded and double-stranded compounds include but are not limited to oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, a compound described herein has a nucleobase sequence that, when written in the 5' to 3' direction, comprises the reverse complement of the target segment of a target nucleic acid to which it is targeted.

In certain embodiments, a compound described herein comprises an oligonucleotide 10 to 30 linked subunits in length. In certain embodiments, a compound described herein comprises an oligonucleotide 12 to 30 linked subunits in length. In certain embodiments, a compound described herein comprises an oligonucleotide 12 to 22 linked subunits in length. In certain embodiments, compound escribed herein comprises an oligonucleotide 14 to 30 linked subunits in length. In certain embodiments, compound described herein comprises an oligonucleotide 14 to 20 linked subunits in length. In certain embodiments, a compound described herein comprises an oligonucleotide 15 to 30 linked subunits in length. In certain embodiments, a compound described herein comprises an oligonucleotide 15 to 20 linked subunits in length. In certain embodiments, a compound described herein comprises an oligonucleotide 16 to 30 linked subunits in length. In certain embodiments, a compound described herein comprises an oligonucleotide 16 to 20 linked subunits in length. In certain embodiments, a compound described herein comprises an oligonucleotide 17 to 30 linked subunits in length. In certain embodiments, a compound described herein comprises an oligonucleotide 17 to 20 linked subunits in length. In certain embodiments, a compound described herein comprises an oligonucleotide 18 to 30 linked subunits in length. In certain embodiments, a compound described herein comprises an oligonucleotide 18 to 21 linked subunits in length. In certain embodiments, a compound described herein comprises an oligonucleotide 18 to 20 linked subunits in length. In certain embodiments, a compound described herein comprises an oligonucleotide 20 to 30 linked subunits in length. In other words, such oligonucleotides are 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits in length, respectively. In certain embodiments, a compound described herein comprises an oligonucleotide 14 linked subunits in length. In certain embodiments, a compound described herein comprises an oligonucleotide 16 linked subunits in length. In certain embodiments, a compound described herein comprises an oligonucleotide 17 linked subunits in length. In certain embodiments, compound described herein comprises an oligonucleotide 18 linked subunits in length. In certain embodiments, a compound described herein comprises an oligonucleotide 19 linked subunits in length. In certain embodiments, a compound described herein comprises an oligonucleotide 20 linked subunits in length. In other embodiments, a compound described herein comprises an oligonucleotide 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the compound described herein comprises an oligonucleotide 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the linked subunits are nucleotides, nucleosides, or nucleobases.

In certain embodiments, the compound may further comprise additional features or elements, such as a conjugate group, that are attached to the oligonucleotide. In certain embodiments, such compounds are antisense compounds. In certain embodiments, such compounds are oligomeric compounds. In embodiments where a conjugate group comprises a nucleoside (i.e. a nucleoside that links the conjugate group to the oligonucleotide), the nucleoside of the conjugate group is not counted in the length of the oligonucleotide.

In certain embodiments, compounds may be shortened or truncated. For example, a single subunit may be deleted from the 5' end (5' truncation), or alternatively from the 3' end (3' truncation). A shortened or truncated compound targeted to an APOL1 nucleic acid may have two subunits deleted from the 5' end, or alternatively may have two subunits deleted from the 3' end, of the compound. Alternatively, the deleted nucleosides may be dispersed throughout the compound.

When a single additional subunit is present in a lengthened compound, the additional subunit may be located at the 5' or 3' end of the compound. When two or more additional subunits are present, the added subunits may be adjacent to each other, for example, in a compound having two subunits added to the 5' end (5' addition), or alternatively to the 3' end (3' addition), of the compound. Alternatively, the added subunits may be dispersed throughout the compound.

It is possible to increase or decrease the length of a compound, such as an oligonucleotide, and/or introduce mismatch bases without eliminating activity (Woolf et al. *Proc. Natl. Acad. Sci. USA* 1992, 89:7305-7309: Gautschi et al. *J. Natl. Cancer Inst.* March 2001, 93:463-471; Maher and Dolnick *Nuc. Acid. Res.* 1998, 16:3341-3358). However, seemingly small changes in oligonucleotide sequence, chemistry and motif can make large differences in one or more of the many properties required for clinical development (Seth et al. *J. Med. Chem.* 2009, 52, 10; Egli et al. *J. Am. Chem. Soc.* 2011, 133, 16642).

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term "RNAi" is meant to be equivalent to other terms used to describe sequence specific RNA interference, such as post transcriptional gene silencing, translational inhibition, or epigenetics.

In certain embodiments, a compound described herein can comprise any of the oligonucleotide sequences targeted to APOL1 described herein. In certain embodiments, the compound can be double-stranded. In certain embodiments, the compound comprises a first strand comprising at least an 8, 9, 10, 11, 12, 13, 14, 15, 16, 17, 18, 19, or 20 contiguous nucleobase portion of any one of SEQ ID NOs: 13-1941 and a second strand. In certain embodiments, the compound comprises a first strand comprising the nucleobase sequence of any one of SEQ ID NOs: 13-1941 and a second strand. In certain embodiments, the compound comprises ribonucleotides in which the first strand has uracil (U) in place of thymine (T) in any one of SEQ ID NOs 13-1941. In certain embodiments, the compound comprises (i) a first strand comprising a nucleobase sequence complementary to the site on APOL1 to which any of SEQ ID NOs: 13-1941 is targeted, and (ii) a second strand. In certain embodiments, the compound comprises one or more modified nucleotides in which the 2' position in the sugar contains a halogen (such as fluorine group: 2'-F) or contains an alkoxy group (such as a methoxy group: 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains one or two capped strands, as disclosed, for example, by WO 00/63364, filed Apr. 19, 2000.

In certain embodiments, the first strand of the compound is an siRNA guide strand and the second strand of the compound is an siRNA passenger strand. In certain embodiments, the second strand of the compound is complementary to the first strand. In certain embodiments, each strand of the compound is 16, 17, 18, 19, 20, 21, 22, or 23 linked nucleosides in length. In certain embodiments, the first or second strand of the compound can comprise a conjugate group.

In certain embodiments, a compound described herein can comprise any of the oligonucleotide sequences targeted to APOL1 described herein. In certain embodiments, the compound is single stranded. In certain embodiments, such a compound is a single-stranded RNAi (ssRNAi) compound. In certain embodiments, the compound comprises at least an 8, 9, 10, 11, 12, 13, 14, 15, 16, 17, 18, 19, or 20 contiguous nucleobase portion of any one of SEQ ID NOs: 13-1941. In certain embodiments, the compound comprises the nucleobase sequence of any one of SEQ ID NOs: 13-1941. In certain embodiments, the compound comprises ribonucleotides in which uracil (U) is in place of thymine (T) in any one of SEQ ID NOs: 13-1941. In certain embodiments, the compound comprises a nucleobase sequence complementary to the site on APOL1 to which any of SEQ ID NOs: 13-1941 is targeted. In certain embodiments, the compound comprises one or more modified nucleotides in which the 2' position in the sugar contains a halogen (such as fluorine group: 2'-F) or contains an alkoxy group (such as a methoxy group: 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains a capped strand, as disclosed, for example, by WO 00/63364, filed Apr. 19, 2000. In certain embodiments, the compound consists of 16, 17, 18, 19, 20, 21, 22, or 23 linked nucleosides. In certain embodiments, the compound can comprise a conjugate group.

Certain Mechanisms

In certain embodiments, compounds described herein comprise or consist of modified oligonucleotides. In certain embodiments, compounds described herein are antisense compounds. In certain embodiments, compounds comprise oligomeric compounds. In certain embodiments, compounds described herein are capable of hybridizing to a target nucleic acid, resulting in at least one antisense activity. In certain embodiments, compounds described herein selectively affect one or more target nucleic acid. Such compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in a significant undesired antisense activity.

In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ssRNA).

In certain embodiments, hybridization of compounds described herein to a target nucleic acid does not result in recruitment of a protein that cleaves that target nucleic acid. In certain such embodiments, hybridization of the compound to the target nucleic acid results in alteration of splicing of the target nucleic acid. In certain embodiments, hybridization of the compound to a target nucleic acid results in inhibition of a binding interaction between the target nucleic acid and a protein or other nucleic acid. In certain such embodiments, hybridization of the compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

Target Nucleic Acids, Target Regions and Nucleotide Sequences

In certain embodiments, compounds described herein comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: an mRNA and a pre-mRNA, including intronic, exonic and untranslated regions. In certain embodiments, the target RNA is an mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

Nucleotide sequences that encode APOL1 include, without limitation, the following: RefSEQ No. NM_003661.3 (incorporated by reference, disclosed herein as SEQ ID NO: 1), NT_011520.9 truncated from nucleotides 15986452 to 16001905 (SEQ ID NO: 2), NM_001136541.1 (SEQ ID NO: 3), NM_001136540.1 (SEQ ID NO: 4), NM_145343.2 (SEQ ID NO: 5), DC339680.1 (SEQ ID NO: 6), AK309143.1 (SEQ ID NO: 7), NT_011520.13 truncated from nucleotides 17543446 to 17543655 (SEQ ID NO: 8), or NC_000022.11 truncated from nucleotides 36250001 to 36271000 (SEQ ID NO: 9).

Hybridization

In some embodiments, hybridization occurs between a compound disclosed herein and a APOL1 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the compounds provided herein are specifically hybridizable with a APOL1 nucleic acid.

Complementarity

An oligonucleotide is said to be complementary to another nucleic acid when the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. An oligonucleotide is fully complementary or 100% complementary when such oligonucleotides have nucleobase matches at each nucleoside without any nucleobase mismatches.

In certain embodiments, compounds described herein comprise or consist of modified oligonucleotides. In certain embodiments, compounds described herein are antisense compounds. In certain embodiments, compounds comprise oligomeric compounds. Non-complementary nucleobases between a compound and a APOL1 nucleic acid may be tolerated provided that the compound remains able to specifically hybridize to a target nucleic acid. Moreover, a compound may hybridize over one or more segments of a APOL1 nucleic acid such that intervening or adjacent segments are not involved in the hybridization event (e.g., a loop structure, mismatch or hairpin structure).

In certain embodiments, the compounds provided herein, or a specified portion thereof, are, are at least, or are up to 70%, 80%, 85%, 86%, 87%, 88%, 89%, 90%, 91%, 92%, 93%, 94%, 95%, 96%, 97%, 98%, 99%, or 100% complementary to a APOL1 nucleic acid, a target region, target segment, or specified portion thereof. In certain embodiments, the compounds provided herein, or a specified portion thereof, are 70% to 75%, 75% to 80%, 80% to 85%, 85% to 90%, 90% to 95%, 95% to 100%, or any number in between these ranges, complementary to a APOL1 nucleic acid, a target region, target segment, or specified portion thereof. Percent complementarity of a compound with a target nucleic acid can be determined using routine methods.

For example, a compound in which 18 of 20 nucleobases of the compound are complementary to a target region, and would therefore specifically hybridize, would represent 90 percent complementarity. In this example, the remaining non-complementary nucleobases may be clustered or interspersed with complementary nucleobases and need not be contiguous to each other or to complementary nucleobases. As such, a compound which is 18 nucleobases in length having four non-complementary nucleobases which are flanked by two regions of complete complementarity with the target nucleic acid would have 77.8% overall complementarity with the target nucleic acid. Percent complementarity of a compound with a region of a target nucleic acid can be determined routinely using BLAST programs (basic local alignment search tools) and PowerBLAST programs known in the art (Altschul et al., *J. Mol. Biol.,* 1990, 215, 403 410: Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, compounds described herein, or specified portions thereof, are fully complementary (i.e. 100% complementary) to a target nucleic acid, or specified portion thereof. For example, a compound may be fully complementary to a APOL1 nucleic acid, or a target region, or a target segment or target sequence thereof. As used herein, "fully complementary" means each nucleobase of a compound is complementary to the corresponding nucleobase of a target nucleic acid. For example, a 20 nucleobase compound is fully complementary to a target sequence that is 400 nucleobases long, so long as there is a corresponding 20 nucleobase portion of the target nucleic acid that is fully complementary to the compound. Fully complementary can also be used in reference to a specified portion of the first and/or the second nucleic acid. For example, a 20 nucleobase portion of a 30 nucleobase compound can be "fully complementary." to a target sequence that is 400 nucleobases long. The 20 nucleobase portion of the 30 nucleobase compound is fully complementary to the target sequence if the target sequence has a corresponding 20 nucleobase portion wherein each nucleobase is complementary to the 20 nucleobase portion of the compound. At the same time, the entire 30 nucleobase compound may or may not be fully complementary to the target sequence, depending on whether the remaining 10 nucleobases of the compound are also complementary to the target sequence.

In certain embodiments, compounds described herein comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region. In certain embodiments, the mismatch is specifically positioned within an oligonucleotide not having a gapmer motif. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

The location of a non-complementary nucleobase may be at the 5' end or 3' end of the compound. Alternatively, the non-complementary nucleobase or nucleobases may be at an internal position of the compound. When two or more non-complementary nucleobases are present, they may be contiguous (i.e. linked) or non-contiguous. In one embodiment, a non-complementary nucleobase is located in the wing segment of a gapmer oligonucleotide.

In certain embodiments, compounds described herein that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a APOL1 nucleic acid, or specified portion thereof.

In certain embodiments, compounds described herein that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a APOL1 nucleic acid, or specified portion thereof.

In certain embodiments, compounds described herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of a compound. In certain embodiments, the compounds, are complementary to at least an 8 nucleobase portion of a target segment. In certain embodiments, the compounds are complementary to at least a 9 nucleobase portion of a target segment. In certain embodiments, the compounds are complementary to at least a 10 nucleobase portion of a target segment. In certain embodiments, the compounds are complementary to at least an 11 nucleobase portion of a target segment. In certain embodiments, the compounds are complementary to at least a 12 nucleobase portion of a target segment. In certain embodiments, the compounds are complementary to at least a 13 nucleobase portion of a target segment. In certain embodiments, the compounds are complementary to at least a 14 nucleobase portion of a target segment. In certain embodiments, the compounds are complementary to at least a 15 nucleobase portion of a target segment. In certain embodiments, the compounds are complementary to at least a 16 nucleobase portion of a target segment. Also contemplated are compounds that are complementary to at least a 9, 10, 11, 12, 13, 14, 15, 16, 17, 18, 19, 20, or more nucleobase portion of a target segment, or a range defined by any two of these values.

Identity

The compounds provided herein may also have a defined percent identity to a particular nucleotide sequence, SEQ ID NO, or compound represented by a specific ION number, or portion thereof. In certain embodiments, compounds described herein are antisense compounds or oligomeric compounds. In certain embodiments, compounds described herein are modified oligonucleotides. As used herein, a compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the compounds described herein as well as compounds having non-identical bases relative to the compounds provided herein also are contemplated. The non-identical bases may be adjacent to each other or dispersed throughout the compound. Percent identity of a compound is calculated according to the number of bases that have identical base pairing relative to the sequence to which it is being compared.

In certain embodiments, compounds described herein, or portions thereof, are, or are at least, 70%, 75%, 80%, 85%, 90%, 91%, 92%, 93%, 94%, 95%, 96%, 97%, 98%, 99% or 100% identical to one or more of the compounds or SEQ ID NOs, or a portion thereof, disclosed herein. In certain embodiments, compounds described herein are about 70%, 75%, 80%, 85%, 90%, 91%, 92%, 93%, 94%, 95%, 96%, 97%, 98%, or 99% identical, or any percentage between such values, to a particular nucleotide sequence, SEQ ID NO, or compound represented by a specific ION number, or portion thereof, in which the compounds comprise an oligonucleotide having one or more mismatched nucleobases. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

In certain embodiments, compounds described herein comprise or consist of antisense compounds. In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, compounds described herein comprise or consist of oligonucleotides. In certain embodiments, a portion of the oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Certain Modified Compounds

In certain embodiments, compounds described herein comprise or consist of oligonucleotides consisting of linked nucleosides. Oligonucleotides may be unmodified oligonucleotides (RNA or DNA) or may be modified oligonucleotides. Modified oligonucleotides comprise at least one modification relative to unmodified RNA or DNA (i.e., comprise at least one modified nucleoside (comprising a modified sugar moiety and/or a modified nucleobase) and/or at least one modified internucleoside linkage).

A. Modified Nucleosides

Modified nucleosides comprise a modified sugar moiety or a modified nucleobase or both a modified sugar moiety and a modified nucleobase.

1. Modified Sugar Moieties

In certain embodiments, sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified furanosyl sugar moieties comprising one or more acyclic substituent, including but not limited to substituents at the 2', 4", and/or 5' positions. In certain embodiments, the furanosyl sugar moiety is a ribosyl sugar moiety. In certain embodiments one or more acyclic substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584: Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4-substituent groups suitable for linearlynon-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugars comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted nucleoside or 2'-non-bicyclic modified nucleoside comprises a sugar moiety comprising a linear 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside or 2'-non-bicyclic modified nucleoside comprises a sugar moiety comprising a linear 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside or 2'-non-bicyclic modified nucleoside comprises a sugar moiety comprising a linear 2'-substituent group selected from: F, OCH$_3$, and OCH$_2$CH$_2$OCH$_3$.

Nucleosides comprising modified sugar moieties, such as non-bicyclic modified sugar moieties, are referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. In certain such embodiments, the furanose ring is a ribose ring. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt" when in the S configuration), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., *J. Org. Chem.* 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O-2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—:

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25 (22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Elayadi et al., *Curr. Opinion Invens. Drugs.* 2001, 2, 558-561; Braasch et al., *Chem. Biol.* 2001, 8, 1-7; Orum et al., *Curr. Opinion Mol. Ther.* 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421: Seth et al., U.S. Pat. No. 8,501,805; Allerson et al., US2008/0039618; and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

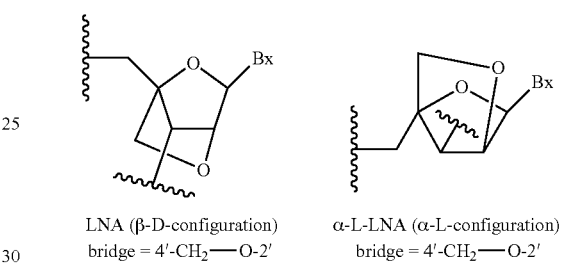

LNA (β-D-configuration)
bridge = 4'-CH$_2$—O-2'

α-L-LNA (α-L-configuration)
bridge = 4'-CH$_2$—O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*. 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see e.g., Leumann, C J. *Bioorg. & Med. Chem.* 2002, 10, 841-854), fluoro HNA:

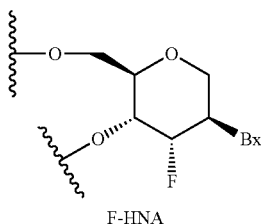

F-HNA ("F-HNA", see e.g., Swayze et al., U.S. Pat. No. 8,088,904; Swayze et al., U.S. Pat. No. 8,440,803; and Swayze et al., U.S. Pat. No. 9,005,906, F-HNA can also be referred to as a F-THP or 3'-fluoro tetrahydropyran), and nucleosides comprising additional modified THP compounds having the formula:

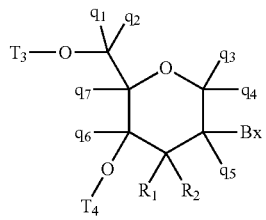

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 47, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

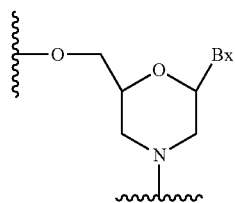

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., US2013/130378.

Many other bicyclic and tricyclic sugar and sugar surrogate ring systems are known in the art that can be used in modified nucleosides.

2. Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds.

In certain embodiments, compounds described herein comprise modified oligonucleotides. In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2 aminopropyladenine, 5-hydroxymethyl cytosine, 5-methylcytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (C≡C—CH3) uracil, 5-propynylcytosine, 6-azouracil, 6-azocytosine, 6-azothymine, 5-ribosyluracil (pscudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859: Englisch et al., Angewandte Chemie, International Edition, 1991, 30, 613: Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S.T., Ed., CRC Press, 2008, 163-166 and 442-443.

Publications that teach the preparation of certain of the above noted modified nucleobases as well as other modified nucleobases include without limitation, Manoharan et al., US2003/0158403, Manoharan et al., US2003/0175906; Dinh et al., U.S. Pat. No. 4,845,205: Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272: Matteucci et al., U.S. Pat. No. 5,434,257; Gmeiner et al., U.S. Pat. No. 5,457,187; Cook et al., U.S. Pat. No. 5,459,255; Frochler et al., U.S. Pat. No. 5,484,908: Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Frochler et al., U.S. Pat. No. 5,594,121: Switzer et al., U.S. Pat. No. 5,596,091; Cook et al., U.S. Pat. No. 5,614,617: Frochler et al., U.S. Pat. No. 5,645,985; Cook et al., U.S. Pat. No. 5,681,941; Cook et al., U.S. Pat. No. 5,811,534; Cook et al., U.S. Pat. No. 5,750,692: Cook et al., U.S. Pat. No. 5,948,903: Cook et al., U.S. Pat. No. 5,587,470; Cook et al., U.S. Pat. No. 5,457,191: Matteucci et al., U.S. Pat. No. 5,763,588: Frochler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

In certain embodiments, compounds targeted to a APOL1 nucleic acid comprise one or more modified nucleobases. In certain embodiments, the modified nucleobase is 5-methylcytosine. In certain embodiments, each cytosine is a 5-methylcytosine.

Modified Internucleoside Linkages

The naturally occurring internucleoside linkage of RNA and DNA is a 3' to 5' phosphodiester linkageIn certain embodiments, compounds described herein having one or more modified, i.e. non-naturally occurring, internucleoside linkages are often selected over compounds having naturally occurring internucleoside linkages because of desirable properties such as, for example, enhanced cellular uptake, enhanced affinity for target nucleic acids, and increased stability in the presence of nucleases.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

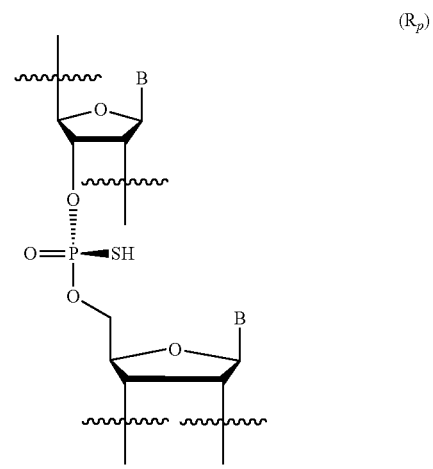

-continued

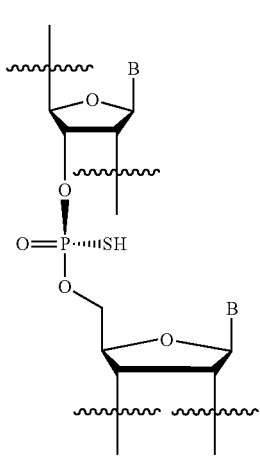

(S$_p$)

Unless otherwise indicated, chiral internucleoside linkages of modified oligonucleotides described herein can be stereorandom or in a particular stereochemical configuration.

In certain embodiments, compounds targeted to an APOL1 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, compounds described herein comprise oligonucleotides. Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS-P=S"). Representative non-phosphorus containing internucleoside linking groups include but are not limited to methylenemethylimino (—CH2-N(CH3)-O—CH2-), thiodiester, thionocarbamate (—O—C(=O)(NH)—S—); siloxane (—O—SiH2-O—); and N,N'-dimethylhydrazine (—CH2-N(CH3)-N(CH3)-). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Representative chiral internucleoside linkages include but are not limited to alkylphosphonates and phosphorothioates. Methods of preparation of phosphorous-containing and non-phosphorous-containing internucleoside linkages are well known to those skilled in the art.

Neutral internucleoside linkages include, without limitation, phosphotriesters, methylphosphonates, MMI (3'-CH2-N(CH3)-O-5'), amide-3 (3'-CH2-C(=O)—N(H)-5'), amide-4 (3'-CH2-N(H)—C(=O)-5'), formacetal (3'-O-CH2-O-5'), methoxypropyl, and thioformacetal (3'-S-CH2-O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research: Y. S. Sanghvi and P. D. Cook, Eds., ACS Symposium Series 580: Chapters 3 and 4, 40-65). Further neutral internucleoside linkages include nonionic linkages comprising mixed N, O, S and CH2 component parts.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosponate linkages. In certain embodiments, oligonucleotides having a gapmer nucleoside motif comprise a linkage motif comprising all phosphorothioate linkages except for one or two methylphosponate linkages. In certain embodiments, one methylphosponate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

3. Certain Motifs

In certain embodiments, compounds described herein comprise oligonucleotides. Oligonucleotides can have a motif, e.g. a pattern of unmodified and/or modified sugar moieties, nucleobases, and/or internucleoside linkages. In certain embodiments, modified oligonucleotides comprise one or more modified nucleoside comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

a. Certain Sugar Motifs

In certain embodiments, compounds described herein comprise oligonucleotides. In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which comprises two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, the wings of a gapmer comprise 2-5 nucleosides. In certain embodiments, the wings of a gapmer comprise 3-5 nucleosides. In certain embodiments, the nucleosides of a gapmer are all modified nucleosides.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiment, each nucleoside of the gap of a gapmer is an unmodified 2'-deoxy nucleoside.

In certain embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In certain such embodiments, each nucleoside of the gap is an unmodified 2'-deoxy nucleoside. In certain such embodiments, each nucleoside of each wing is a modified nucleoside.

In certain embodiments, a modified oligonucleotide has a fully modified sugar motif wherein each nucleoside of the modified oligonucleotide comprises a modified sugar moiety. In certain embodiments, modified oligonucleotides comprise or consist of a region having a fully modified sugar motif wherein each nucleoside of the region comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified oligonucleotide comprises the same 2'-modification.

b. Certain Nucleobase Motifs

In certain embodiments, compounds described herein comprise oligonucleotides. In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

c. Certain Internucleoside Linkage Motifs

In certain embodiments, compounds described herein comprise oligonucleotides. In certain embodiments, oligonucleotides comprise modified and/or unmodified internucleoside linkages arranged along the oligonucleotide or region thereof in a defined pattern or motif. In certain embodiments, essentially each internucleoside linking group is a phosphate internucleoside linkage (P=O). In certain embodiments, each internucleoside linking group of a modified oligonucleotide is a phosphorothioate (P=S). In certain embodiments, each internucleoside linking group of a modified oligonucleotide is independently selected from a phosphorothioate and phosphate internucleoside linkage. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

4. Certain Modified Oligonucleotides

In certain embodiments, compounds described herein comprise modified oligonucleotides. In certain embodiments, the above modifications (sugar, nucleobase, internucleoside linkage) are incorporated into a modified oligonucleotide. In certain embodiments, modified oligonucleotides are characterized by their modification, motifs, and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such gapmer oligonucleotides may comprise one or more modified nucleobase independent of the gapmer pattern of the sugar modifications. Furthermore, in certain instances, an oligonucleotide is described by an overall length or range and by lengths or length ranges of two or more regions (e.g., a regions of nucleosides having specified sugar modifications), in such circumstances it may be possible to select numbers for each range that result in an oligonucleotide having an overall length falling outside the specified range. In such circumstances, both elements must be satisfied. For example, in certain embodiments, a modified oligonucleotide consists of 15-20 linked nucleosides and has a sugar motif consisting of three regions, A, B, and C, wherein region A consists of 2-6 linked nucleosides having a specified sugar motif, region B consists of 6-10 linked nucleosides having a specified sugar motif, and region C consists of 2-6 linked nucleosides having a specified sugar motif. Such embodiments do not include modified oligonucleotides where A and C each consist of 6 linked nucleosides and B consists of 10 linked nucleosides (even though those numbers of nucleosides are permitted within the requirements for A, B, and C) because the overall length of such oligonucleotide is 22, which exceeds the upper limit of the overall length of the modified oligonucleotide (20). Herein, if a description of an oligonucleotide is silent with respect to one or more parameter, such parameter is not limited. Thus, a modified oligonucleotide described only as having a gapmer sugar motif without further description may have any length, internucleoside linkage motif, and nucleobase motif. Unless otherwise indicated, all modifications are independent of nucleobase sequence.

Certain Conjugated Compounds

In certain embodiments, the compounds described herein comprise or consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

In certain embodiments, the oligonucleotide is modified. In certain embodiments, the oligonucleotide of a compound has a nucleobase sequence that is complementary to a target nucleic acid. In certain embodiments, oligonucleotides are complementary to a messenger RNA (mRNA). In certain embodiments, oligonucleotides are complementary to a sense transcript.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearanceIn certain embodiments, conjugate groups impart a new property on the attached oligonucleotide, e.g., fluorophores or reporter groups that enable detection of the oligonucleotide.

Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO J.,* 1991, 10, 1111-1118: Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654: Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic, a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, i, 923-937), a tocopherol group (Nishina et al., *Molecular Therapy Nucleic Acids,* 2015, 4, e220; doi: 10.1038/mtna.2014.72 and Nishina et al., *Molecular Therapy.* 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain compounds, a conjugate group is a single chemical bond (i.e. conjugate moiety is attached to an oligonucleotide via a conjugate linker through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the compound after it reaches a target tissue. Accordingly, linker-nucleosides are typically linked to one another and to the remainder of the compound through cleavable bonds. In certain embodiments, such cleavable bonds are phosphodiester bonds.

Herein, linker-nucleosides are not considered to be part of the oligonucleotide. Accordingly, in embodiments in which a compound comprises an oligonucleotide consisting of a specified number or range of linked nucleosides and/or a specified percent complementarity to a reference nucleic acid and the compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, a compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such a compound is more than 30. Alternatively, an compound may comprise a modified oligonucleotide consisting of 8-30 nucleosides and no conjugate group. The total number of contiguous linked nucleosides in such a compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances compounds comprising a particular conjugate moiety are better taken up by a particular cell type, but once the compound has been taken up, it is desirable that the conjugate group be cleaved to release the unconjugated or parent oligonucleotide. Thus, certain conjugate may comprise one or more cleavable moieties, typically within the conjugate linker. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, one or more linker-nucleosides are linked to one another and/or to the remainder of the compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

Compositions and Methods for Formulating Pharmaceutical Compositions

Compounds described herein may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

Certain embodiments provide pharmaceutical compositions comprising one or more compounds or a salt thereof. In certain embodiments, the compounds are antisense compounds or oligomeric compounds. In certain embodiments, the compounds comprise or consist of a modified oligonucleotide. In certain such embodiments, the pharmaceutical composition comprises a suitable pharmaceutically acceptable diluent or carrier. In certain embodiments, a pharmaceutical composition comprises a sterile saline solution and one or more compound. In certain embodiments, such pharmaceutical composition consists of a sterile saline solution and one or more compound. In certain embodiments, the sterile saline is pharmaceutical grade saline. In certain embodiments, a pharmaceutical composition comprises one or more compound and sterile water. In certain embodiments, a pharmaceutical composition consists of one compound and sterile water. In certain embodiments, the sterile water is pharmaceutical grade water. In certain embodiments, a pharmaceutical composition comprises one or more compound and phosphate-buffered saline (PBS). In certain embodiments, a pharmaceutical composition consists of one or more compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

A compound described herein targeted to APOL1 nucleic acid can be utilized in pharmaceutical compositions by combining the compound with a suitable pharmaceutically acceptable diluent or carrier. In certain embodiments, a pharmaceutically acceptable diluent is water, such as sterile water suitable for injection. Accordingly, in one embodiment, employed in the methods described herein is a pharmaceutical composition comprising a compound targeted to APOL1 nucleic acid and a pharmaceutically acceptable diluent. In certain embodiments, the pharmaceutically acceptable diluent is water. In certain embodiments, the compound comprises or consists of a modified oligonucleotide provided herein.

Pharmaceutical compositions comprising compounds provided herein encompass any pharmaceutically acceptable salts, esters, or salts of such esters, or any other oligonucleotide which, upon administration to an animal, including a human, is capable of providing (directly or indirectly) the biologically active metabolite or residue thereof. In certain embodiments, the compounds are antisense compounds or oligomeric compounds. In certain embodiments, the compound comprises or consists of a modified oligonucleotide. Accordingly, for example, the disclosure is also drawn to pharmaceutically acceptable salts of compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of a compound which are cleaved by endogenous nucleases within the body, to form the active compound. In certain embodiments, the compounds or compositions further comprise a pharmaceutically acceptable carrier or diluent.

Certain Selected Compounds

Approximately 1930 newly designed compounds and a few previously disclosed compounds of various lengths, chemistries, and motifs were tested for their effect on human APOL1 mRNA in vitro in several cell types (Example 1). Of 1930 compounds tested for potency at a single dose in vitro, 373 selected compounds were tested for dose dependent inhibition in A431 cells (Example 2). Of the 373 compounds tested by dose response assays, 86 oligonucleotides were selected for in vivo efficacy and tolerability in rodents.

In the in vivo rodent tolerability models, body weights and organ weights, liver function markers (such as alanine transaminase, aspartate transaminase and bilirubin), hematology markers (such as HCT, white blood cell counts, platelet counts, RBC counts, MCH, and MCHC), and kidney function markers (such as BUN and creatinine) were measured. In the hAPOL1 transgenic mouse model, in vivo reduction of hAPOL1 mRNA was measured.

ION #s 793406, 904763, 905469, 905505, 905634, 905665, 972190, and 972163 were tested for activity, pharmacokinetic profile and tolerability in cynomolgus monkeys (Example 9). Treatment with some of the compounds caused reduction of APOL1 mRNA expression in liver tissue. Specifically, treatment with ION 904763 and ION 972190, which were cross-reactive with the APOL1 cynomolgus monkey gene sequence, caused significant reduction of APOL1 mRNA expression in liver tissue, compared to the PBS control. It was noted that ION 972190 caused the highest reduction of APOL1 mRNA expression compared to the PBS control. Treatment with the compounds was well tolerated in the monkeys, in particular, treatment with ION 972190.

Accordingly, provided herein are compounds with any one or more of the improved properties. In certain embodiments, the compounds as described herein are potent and tolerable.

EXAMPLES

The Examples below describe the screening process to identify lead compounds targeted to APOL1. ION 793406, 904763, 905469, 905505, 905634, 905665, 972190, and 972163 resulted in high potency and tolerability, for instance. ION 972190 exhibited high potency and tolerability.

Non-Limiting Disclosure and Incorporation by Reference

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG" and compounds having other modified nucleobases, such as "AT$^m$CGAUCG," wherein $^m$C indicates a cytosine base comprising a methyl group at the 5-position.

Certain compounds described herein (e.g. modified oligonucleotides) have one or more asymmetric centers and thus give rise to enantiomers, diastereomers, and other stereoisomeric configurations that may be defined, in terms of absolute stereochemistry, as (R) or (S), as α or β, such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms. Likewise, all tautomeric forms of the compounds provided herein are included unless otherwise indicated. Unless otherwise indicated, oligomeric compounds and modified oligonucleotides described herein are intended to include corresponding salt forms.

Compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S.

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Antisense Inhibition of Human APOL1 in A431 Cells

Antisense oligonucleotides with various chemistry motifs were designed targeting an APOL1 nucleic acid and were tested for their effects on APOL1 mRNA in vitro.

3-10-3 cEt Gapmers

The newly designed chimeric antisense oligonucleotides in the Tables below were designed as 3-10-3 cEt gapmers. The gapmers are 16 nucleosides in length, wherein the central gap segment comprises of ten 2'-deoxynucleosides and is flanked by wing segments on the 5' direction and the 3' direction comprising three nucleosides each. Each nucleoside in the 5' wing segment and each nucleoside in the 3' wing segment has a cEt modification. The internucleoside linkages throughout each gapmer are phosphorothioate (P=S) linkages. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human APOL1 mRNA, designated herein as SEQ ID NO: 1 (GENBANK Accession No. NM_003661.3) or the human APOL1 genomic sequence, designated herein as SEQ ID NO: 2 (GENBANK Accession No. NT_011520.9 truncated from nucleotides 15986452 to 16001905). 'n/a' indicates that the antisense oligonucleotide does not target that particular gene sequence with 100% complementarity.

The antisense oligonucleotides were tested in a series of experiments that had similar culture conditions. The results for each experiment are presented in separate tables shown below. Cultured A431 cells at a density of 10,000 cells per well were transfected by free uptake with 4,000 nM antisense oligonucleotide. After a treatment period of approximately 24 hours, RNA was isolated from the cells and APOL1 mRNA levels were measured by quantitative real-time PCR. Human primer probe set RTS35962 (forward sequence GCTACTCCTGCTGACTGATAATG, designated herein as SEQ ID NO: 10; reverse sequence AAGGTTGTCCAGAGCTTTACG, designated herein as SEQ ID NO: 11; probe sequence TGCCCAGGAAT-GAGGCAGATGAG, designated herein as SEQ ID NO: 12) was used to measure mRNA levels. APOL1 mRNA levels were adjusted according to total RNA content, as measured by RIBOGREEN®. Results are presented as percent inhibition of APOL1, relative to untreated control cells. Oligonucleotides listed in Table 28 were screened in later experiments.

TABLE 1

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 83 | 13 |
| 903425 | 23 | 38 | 516 | 531 | AAGATATACCGAGGAA | 24 | 14 |
| 903457 | 124 | 139 | 617 | 632 | TCCCCTGGCAGAGACT | 54 | 15 |
| 903489 | 250 | 265 | 4543 | 4558 | TCGCTCCAGCTTCCTC | 55 | 16 |
| 903521 | 302 | 317 | 4777 | 4792 | TTACTTTGAGGATCTC | 48 | 17 |
| 903617 | 559 | 574 | 12650 | 12665 | ACTGCTGGCCTTTATC | 76 | 18 |
| 903649 | 628 | 643 | 12719 | 12734 | GGAGCCTTCTTATGTT | 8 | 19 |
| 903681 | 669 | 684 | 12760 | 12775 | GGTGCCTTTGTGGACC | 0 | 20 |
| 903713 | 740 | 755 | 12831 | 12846 | AGACCCATGCCGACGA | 30 | 21 |
| 903745 | 810 | 825 | 12901 | 12916 | AGCGGCTGTGATTCCC | 46 | 22 |
| 903777 | 849 | 864 | 12940 | 12955 | CTTTCCGTAGTCCATG | 17 | 23 |
| 903809 | 930 | 945 | 13021 | 13036 | ACCCAAAAACTCCCTC | 82 | 24 |
| 903841 | 1007 | 1022 | 13098 | 13113 | GCACGGATGTCCTTCC | 57 | 25 |
| 903873 | 1083 | 1098 | 13174 | 13189 | GATTGGCTCAGTGACC | 59 | 26 |
| 903905 | 1126 | 1141 | 13217 | 13232 | TGGGTTCATTAACCCT | 3 | 27 |
| 903937 | 1211 | 1226 | 13302 | 13317 | ACGAGGTAGACTACAT | 76 | 28 |
| 903969 | 1344 | 1359 | 13435 | 13450 | TTCTTGGTCCGCCTGC | 84 | 29 |
| 904001 | 1719 | 1734 | 13810 | 13825 | AATGTTTGCATTTGGG | 98 | 30 |
| 904033 | 1798 | 1813 | 13889 | 13904 | GTGCTCAGCTATGGAA | 90 | 31 |
| 904065 | 1925 | 1940 | 14016 | 14031 | TAGTCTAAAGTAAACT | 26 | 32 |
| 904097 | 2283 | 2298 | 14374 | 14389 | GCTGGTTCCTTCAAGC | 25 | 33 |
| 904129 | 2412 | 2427 | 14503 | 14518 | CATTCTTCGGAGGACA | 78 | 34 |
| 904161 | 2510 | 2525 | 14601 | 14616 | TCAGGAAGCCGCTGCC | 58 | 35 |
| 904193 | 2599 | 2614 | 14690 | 14705 | ACCTGCCCTTCAGTGT | 52 | 36 |
| 904225 | 2723 | 2738 | 14814 | 14829 | CTGTTTACTTACCGGG | 83 | 37 |
| 904257 | 2804 | 2819 | 14895 | 14910 | TCAATCCTGGGCGGCG | 85 | 38 |
| 904321 | N/A | N/A | 1373 | 1388 | CATGATTGCAAAGCTG | 89 | 39 |
| 904353 | N/A | N/A | 836 | 851 | GCTTTGTGAACCCATC | 58 | 40 |
| 904385 | N/A | N/A | 2479 | 2494 | CAAGCCCAGTCCAATT | 23 | 41 |
| 904417 | N/A | N/A | 2988 | 3003 | GATGTTTGTCTTCTGG | 88 | 42 |
| 904449 | N/A | N/A | 4339 | 4354 | GCCAGTGTGTATTGCA | 40 | 43 |
| 904481 | N/A | N/A | 4711 | 4726 | ACAAATTGTGGGATCA | 0 | 44 |
| 904513 | N/A | N/A | 5057 | 5072 | CTAGGTGCCAGGGTAG | 47 | 45 |

TABLE 1-continued

Inhibition of APOL1 mRNA by 3-10-3 cEt
gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904545 | N/A | N/A | 5114 | 5129 | CCCCCCCCCCGCTGAT | 9 | 46 |
| 904577 | N/A | N/A | 5292 | 5307 | GGGCCACTCAGAGCAA | 0 | 47 |
| 904609 | N/A | N/A | 5357 | 5372 | GTGGCAAAGGACAGAC | 72 | 48 |
| 904641 | N/A | N/A | 5489 | 5504 | CCCTATTGTGTGGCAG | 66 | 49 |
| 904673 | N/A | N/A | 5681 | 5696 | TTTTTCTTTGACCGGG | 74 | 50 |
| 904705 | N/A | N/A | 5765 | 5780 | CGAAGCCTCCTCCAGT | 65 | 51 |
| 904737 | N/A | N/A | 5806 | 5821 | CACCCGATAAACCTTG | 67 | 52 |
| 904769 | N/A | N/A | 5861 | 5876 | AGGCAGTTTTGTAAGT | 76 | 53 |
| 904801 | N/A | N/A | 5932 | 5947 | ATTCGGAGACCTCCCT | 5 | 54 |
| 904833 | N/A | N/A | 5964 | 5979 | CCTGGGCAAGGCTAAG | 35 | 55 |
| 904865 | N/A | N/A | 6137 | 6152 | TTACTCCACACCTTAA | 39 | 56 |
| 904897 | N/A | N/A | 6205 | 6220 | TTTGGTACAAAACTGC | 71 | 57 |
| 904929 | N/A | N/A | 6260 | 6275 | TGTCTCACTAAACCCC | 69 | 58 |
| 904961 | N/A | N/A | 6328 | 6343 | GACCAGTGAGATCCAA | 85 | 59 |
| 904993 | N/A | N/A | 6401 | 6416 | ACCACCTGTAGGGACA | 50 | 60 |
| 905025 | N/A | N/A | 6541 | 6556 | GGGTACTTCTGTTAGA | 82 | 61 |
| 905057 | N/A | N/A | 6599 | 6614 | CAGCTGTAACCCCCTG | 44 | 62 |
| 905089 | N/A | N/A | 6647 | 6662 | CAGCCCTGAAACATTC | 13 | 63 |
| 905121 | N/A | N/A | 6793 | 6808 | GCGATTGTCTTGTTTT | 93 | 64 |
| 905153 | N/A | N/A | 6878 | 6893 | GCCGTGGCAACTCTGT | 0 | 65 |
| 905185 | N/A | N/A | 6994 | 7009 | GGGTCGGCTGAGTGCT | 61 | 66 |
| 905217 | N/A | N/A | 7156 | 7171 | ACCTCCATGTTGCCTC | 42 | 67 |
| 905249 | N/A | N/A | 7243 | 7258 | GCTGGTCTTGGGCACT | 34 | 68 |
| 905281 | N/A | N/A | 7338 | 7353 | CTTATAGCTTACCTGT | 27 | 69 |
| 905313 | N/A | N/A | 7474 | 7489 | GAGTCACCGCCCAAAA | 59 | 70 |
| 905345 | N/A | N/A | 7842 | 7857 | TTGCCGTGCACACACA | 19 | 71 |
| 905377 | N/A | N/A | 7937 | 7952 | GTTTGCAGGGATCTGG | 86 | 72 |
| 905409 | N/A | N/A | 8000 | 8015 | CAAAGAACTCAAGTCA | 85 | 73 |
| 905441 | N/A | N/A | 8087 | 8102 | ACTGCTCCCTGTAATC | 38 | 74 |
| 905473 | N/A | N/A | 8174 | 8189 | TGTGTTTAGGCATTCA | 87 | 75 |
| 905505 | N/A | N/A | 8321 | 8336 | GTTATGAAATTATTGG | 96 | 76 |
| 905537 | N/A | N/A | 8385 | 8400 | ATGCCTGTTGGGTCAA | 64 | 77 |
| 905569 | N/A | N/A | 8455 | 8470 | GCACCAACATGAAGTG | 71 | 78 |
| 905601 | N/A | N/A | 8625 | 8640 | ACCCTTTTGGCACCTT | 94 | 79 |
| 905633 | N/A | N/A | 8743 | 8758 | TTCTATTAGAGGGCTA | 94 | 80 |
| 905665 | N/A | N/A | 8829 | 8844 | GCTTTAAACTCAGGTG | 93 | 81 |

TABLE 1-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 905697 | N/A | N/A | 8890 | 8905 | GTTTTATGGAGTCATT | 95 | 82 |
| 905729 | N/A | N/A | 8959 | 8974 | GTGCATAACAGCCATT | 19 | 83 |

TABLE 2

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 85 | 13 |
| 903424 | 22 | 37 | 515 | 530 | AGATATACCGAGGAAT | 3 | 84 |
| 903456 | 79 | 94 | 572 | 587 | GGATCCCACCTCCAGT | 9 | 85 |
| 903488 | 227 | 242 | 4520 | 4535 | ACTCCCACACCAAGGA | 27 | 86 |
| 903520 | 301 | 316 | 4776 | 4791 | TACTTTGAGGATCTCC | 65 | 87 |
| 903616 | 558 | 573 | 12649 | 12664 | CTGCTGGCCTTTATCG | 0 | 88 |
| 903648 | 627 | 642 | 12718 | 12733 | GAGCCTTCTTATGTTA | 27 | 89 |
| 903680 | 668 | 683 | 12759 | 12774 | GTGCCTTTGTGGACCT | 24 | 90 |
| 903712 | 739 | 754 | 12830 | 12845 | GACCCATGCCGACGAG | 46 | 91 |
| 903744 | 809 | 824 | 12900 | 12915 | GCGGCTGTGATTCCCA | 0 | 92 |
| 903776 | 848 | 863 | 12939 | 12954 | TTTCCGTAGTCCATGG | 20 | 93 |
| 903808 | 914 | 929 | 13005 | 13020 | ACCTCCTTCAATTTGT | 61 | 94 |
| 903840 | 1006 | 1021 | 13097 | 13112 | CACGGATGTCCTTCCC | 69 | 95 |
| 903872 | 1082 | 1097 | 13173 | 13188 | ATTGGCTCAGTGACCC | 88 | 96 |
| 903904 | 1125 | 1140 | 13216 | 13231 | GGGTTCATTAACCCTC | 22 | 97 |
| 903936 | 1210 | 1225 | 13301 | 13316 | CGAGGTAGACTACATC | 63 | 98 |
| 903968 | 1343 | 1358 | 13434 | 13449 | TCTTGGTCCGCCTGCA | 66 | 99 |
| 904000 | 1717 | 1732 | 13808 | 13823 | TGTTTGCATTTGGGTC | 99 | 100 |
| 904032 | 1797 | 1812 | 13888 | 13903 | TGCTCAGCTATGGAAA | 77 | 101 |
| 904064 | 1924 | 1939 | 14015 | 14030 | AGTCTAAAGTAAACTG | 18 | 102 |
| 904096 | 2282 | 2297 | 14373 | 14388 | CTGGTTCCTTCAAGCC | 77 | 103 |
| 904128 | 2411 | 2426 | 14502 | 14517 | ATTCTTCGGAGGACAT | 71 | 104 |
| 904160 | 2508 | 2523 | 14599 | 14614 | AGGAAGCCGCTGCCTG | 0 | 105 |
| 904192 | 2596 | 2611 | 14687 | 14702 | TGCCCTTCAGTGTTCA | 47 | 106 |
| 904224 | 2722 | 2737 | 14813 | 14828 | TGTTTACTTACCGGGT | 91 | 107 |
| 904256 | 2803 | 2818 | 14894 | 14909 | CAATCCTGGGCGGCGA | 79 | 108 |
| 904320 | N/A | N/A | 1372 | 1387 | ATGATTGCAAAGCTGG | 75 | 109 |
| 904352 | N/A | N/A | 828 | 843 | AACCCATCTGAGCTGT | 34 | 110 |

TABLE 2-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904384 | N/A | N/A | 2476 | 2491 | GCCCAGTCCAATTGTG | 14 | 111 |
| 904416 | N/A | N/A | 2970 | 2985 | ACTCCATGCAGCAAGG | 71 | 112 |
| 904448 | N/A | N/A | 4322 | 4337 | GTCTGCGATGTGCAGA | 21 | 113 |
| 904480 | N/A | N/A | 4705 | 4720 | TGTGGGATCAAATGTG | 0 | 114 |
| 904512 | N/A | N/A | 5056 | 5071 | TAGGTGCCAGGGTAGG | 68 | 115 |
| 904544 | N/A | N/A | 5113 | 5128 | CCCCCCCCCGCTGATT | 16 | 116 |
| 904576 | N/A | N/A | 5291 | 5306 | GGCCACTCAGAGCAAA | 0 | 117 |
| 904608 | N/A | N/A | 5355 | 5370 | GGCAAAGGACAGACCG | 9 | 118 |
| 904640 | N/A | N/A | 5466 | 5481 | CCAGGCCAGGTAGCCG | 21 | 119 |
| 904672 | N/A | N/A | 5666 | 5681 | GGGTATTTTAGATGAC | 76 | 120 |
| 904704 | N/A | N/A | 5764 | 5779 | GAAGCCTCCTCCAGTT | 68 | 121 |
| 904736 | N/A | N/A | 5805 | 5820 | ACCCGATAAACCTTGT | 73 | 122 |
| 904768 | N/A | N/A | 5860 | 5875 | GGCAGTTTTGTAAGTG | 81 | 123 |
| 904800 | N/A | N/A | 5931 | 5946 | TTCGGAGACCTCCCTA | 33 | 124 |
| 904832 | N/A | N/A | 5963 | 5978 | CTGGGCAAGGCTAAGT | 1 | 125 |
| 904864 | N/A | N/A | 6136 | 6151 | TACTCCACACCTTAAT | 18 | 126 |
| 904896 | N/A | N/A | 6204 | 6219 | TTGGTACAAAACTGCA | 68 | 127 |
| 904928 | N/A | N/A | 6259 | 6274 | GTCTCACTAAACCCCA | 71 | 128 |
| 904960 | N/A | N/A | 6327 | 6342 | ACCAGTGAGATCCAAC | 87 | 129 |
| 904992 | N/A | N/A | 6377 | 6392 | GGATGGGCCCACAGGA | 39 | 130 |
| 905024 | N/A | N/A | 6540 | 6555 | GGTACTTCTGTTAGAT | 37 | 131 |
| 905056 | N/A | N/A | 6598 | 6613 | AGCTGTAACCCCCTGA | 54 | 132 |
| 905088 | N/A | N/A | 6646 | 6661 | AGCCCTGAAACATTCC | 39 | 133 |
| 905120 | N/A | N/A | 6792 | 6807 | CGATTGTCTTGTTTTT | 96 | 134 |
| 905152 | N/A | N/A | 6877 | 6892 | CCGTGGCAACTCTGTA | 22 | 135 |
| 905184 | N/A | N/A | 6992 | 7007 | GTCGGCTGAGTGCTCT | 35 | 136 |
| 905216 | N/A | N/A | 7152 | 7167 | CCATGTTGCCTCTGTC | 62 | 137 |
| 905248 | N/A | N/A | 7242 | 7257 | CTGGTCTTGGGCACTC | 25 | 138 |
| 905280 | N/A | N/A | 7336 | 7351 | TATAGCTTACCTGTGG | 59 | 139 |
| 905312 | N/A | N/A | 7472 | 7487 | GTCACCGCCCAAAACC | 51 | 140 |
| 905344 | N/A | N/A | 7840 | 7855 | GCCGTGCACACACAAG | 29 | 141 |
| 905376 | N/A | N/A | 7929 | 7944 | GGATCTGGGAATTATG | 65 | 142 |
| 905408 | N/A | N/A | 7999 | 8014 | AAAGAACTCAAGTCAG | 91 | 143 |
| 905440 | N/A | N/A | 8085 | 8100 | TGCTCCCTGTAATCAC | 55 | 144 |
| 905472 | N/A | N/A | 8173 | 8188 | GTGTTTAGGCATTCAG | 72 | 145 |
| 905504 | N/A | N/A | 8318 | 8333 | ATGAAATTATTGGTTC | 82 | 146 |

TABLE 2-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 905536 | N/A | N/A | 8384 | 8399 | TGCCTGTTGGGTCAAA | 43 | 147 |
| 905568 | N/A | N/A | 8454 | 8469 | CACCAACATGAAGTGA | 0 | 148 |
| 905600 | N/A | N/A | 8624 | 8639 | CCCTTTTGGCACCTTC | 95 | 149 |
| 905632 | N/A | N/A | 8742 | 8757 | TCTATTAGAGGGCTAG | 57 | 150 |
| 905664 | N/A | N/A | 8828 | 8843 | CTTTAAACTCAGGTGA | 62 | 151 |
| 905696 | N/A | N/A | 8887 | 8902 | TTATGGAGTCATTAGT | 79 | 152 |
| 905728 | N/A | N/A | 8958 | 8973 | TGCATAACAGCCATTG | 0 | 153 |

TABLE 3

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 81 | 13 |
| 903428 | 26 | 41 | 519 | 534 | CCCAAGATATACCGAG | 24 | 154 |
| 903460 | 130 | 145 | 623 | 638 | GAATCTTCCCCTGGCA | 55 | 155 |
| 903492 | 255 | 270 | N/A | N/A | CACCCTCGCTCCAGCT | 44 | 156 |
| 903524 | 322 | 337 | 4797 | 4812 | CAGCCCAGTCACCGAG | 14 | 157 |
| 903620 | 562 | 577 | 12653 | 12668 | TGTACTGCTGGCCTTT | 68 | 158 |
| 903652 | 631 | 646 | 12722 | 12737 | CACGGAGCCTTCTTAT | 31 | 159 |
| 903684 | 672 | 687 | 12763 | 12778 | GGTGGTGCCTTTGTGG | 0 | 160 |
| 903716 | 743 | 758 | 12834 | 12849 | GCCAGACCCATGCCGA | 39 | 161 |
| 903748 | 813 | 828 | 12904 | 12919 | CAAAGCGGCTGTGATT | 21 | 162 |
| 903780 | 852 | 867 | 12943 | 12958 | CTTCTTTCCGTAGTCC | 32 | 163 |
| 903812 | 936 | 951 | 13027 | 13042 | GTTCTCACCCAAAAAC | 20 | 164 |
| 903844 | 1011 | 1026 | 13102 | 13117 | GAGGGCACGGATGTCC | 39 | 165 |
| 903876 | 1086 | 1101 | 13177 | 13192 | TGAGATTGGCTCAGTG | 64 | 166 |
| 903908 | 1129 | 1144 | 13220 | 13235 | TGCTGGGTTCATTAAC | 6 | 167 |
| 903940 | 1231 | 1246 | 13322 | 13337 | GTAAGTGCTTTGATTC | 93 | 168 |
| 903972 | 1347 | 1362 | 13438 | 13453 | CAGTTCTTGGTCCGCC | 79 | 169 |
| 904004 | 1743 | 1758 | 13834 | 13849 | TCACCCTCTTTATCCC | 76 | 170 |
| 904036 | 1801 | 1816 | 13892 | 13907 | GCTGTGCTCAGCTATG | 35 | 171 |
| 904068 | 1929 | 1944 | 14020 | 14035 | TCTTTAGTCTAAAGTA | 0 | 172 |
| 904100 | 2336 | 2351 | 14427 | 14442 | TAACTCTTGGGCTTTC | 73 | 173 |
| 904132 | 2415 | 2430 | 14506 | 14521 | CTTCATTCTTCGGAGG | 34 | 174 |

TABLE 3-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904164 | 2513 | 2528 | 14604 | 14619 | TCATCAGGAAGCCGCT | 73 | 175 |
| 904196 | 2613 | 2628 | 14704 | 14719 | GGCCATGGCCCACCAC | 0 | 176 |
| 904228 | 2766 | 2781 | 14857 | 14872 | AGCTTCCTCCCAATGC | 24 | 177 |
| 904260 | 2807 | 2822 | 14898 | 14913 | AGGTCAATCCTGGGCG | 58 | 178 |
| 904324 | N/A | N/A | 1376 | 1391 | TCTCATGATTGCAAAG | 69 | 179 |
| 904356 | N/A | N/A | 871 | 886 | GTCTCAGCAGTCAAAA | 62 | 180 |
| 904388 | N/A | N/A | 2518 | 2533 | TTGGTTCCTAGAAGAA | 36 | 181 |
| 904420 | N/A | N/A | 3414 | 3429 | ACTGAGGGTATATGAA | 82 | 182 |
| 904452 | N/A | N/A | 4361 | 4376 | GTGTGATAACTAGCTG | 86 | 183 |
| 904484 | N/A | N/A | 4738 | 4753 | TTTTGTTGCACCCTTG | 83 | 184 |
| 904516 | N/A | N/A | 5065 | 5080 | GTCATTTGCTAGGTGC | 90 | 185 |
| 904548 | N/A | N/A | 5173 | 5188 | TGGTCAACCTCCTCTC | 0 | 186 |
| 904580 | N/A | N/A | 5305 | 5320 | ATACATTCCCACAGGG | 22 | 187 |
| 904612 | N/A | N/A | 5393 | 5408 | AGGGAGGTAAGGAGCG | 26 | 188 |
| 904644 | N/A | N/A | 5492 | 5507 | AGGCCCTATTGTGTGG | 0 | 189 |
| 904676 | N/A | N/A | 5694 | 5709 | ATTGGGCCTCAGATTT | 57 | 190 |
| 904708 | N/A | N/A | 5768 | 5783 | GCACGAAGCCTCCTCC | 60 | 191 |
| 904740 | N/A | N/A | 5809 | 5824 | ATTCACCCGATAAACC | 47 | 192 |
| 904772 | N/A | N/A | 5870 | 5885 | AACCCAAACAGGCAGT | 69 | 193 |
| 904804 | N/A | N/A | 5935 | 5950 | TGTATTCGGAGACCTC | 47 | 194 |
| 904836 | N/A | N/A | 5967 | 5982 | AAACCTGGGCAAGGCT | 23 | 195 |
| 904868 | N/A | N/A | 6141 | 6156 | ATGCTTACTCCACACC | 75 | 196 |
| 904900 | N/A | N/A | 6211 | 6226 | CCCATGTTTGGTACAA | 54 | 197 |
| 904932 | N/A | N/A | 6263 | 6278 | CCTTGTCTCACTAAAC | 73 | 198 |
| 904964 | N/A | N/A | 6332 | 6347 | CTAAGACCAGTGAGAT | 58 | 199 |
| 904996 | N/A | N/A | 6404 | 6419 | GAAACCACCTGTAGGG | 53 | 200 |
| 905028 | N/A | N/A | 6544 | 6559 | GATGGGTACTTCTGTT | 88 | 201 |
| 905060 | N/A | N/A | 6605 | 6620 | TTAGAACAGCTGTAAC | 50 | 202 |
| 905092 | N/A | N/A | 6684 | 6699 | GGGCTGGTGGATATAA | 0 | 203 |
| 905124 | N/A | N/A | 6796 | 6811 | CGAGCGATTGTCTTGT | 76 | 204 |
| 905156 | N/A | N/A | 6881 | 6896 | GTTGCCGTGGCAACTC | 21 | 205 |
| 905188 | N/A | N/A | 7039 | 7054 | GAGTTTTCCTCAGTC | 49 | 206 |
| 905220 | N/A | N/A | 7161 | 7176 | GAGGCACCTCCATGTT | 41 | 207 |
| 905252 | N/A | N/A | 7260 | 7275 | CAAAGGAGATTCCTCC | 35 | 208 |
| 905284 | N/A | N/A | 7342 | 7357 | CTCCCTTATAGCTTAC | 62 | 209 |
| 905316 | N/A | N/A | 7477 | 7492 | CGAGAGTCACCGCCCA | 72 | 210 |

TABLE 3-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 905348 | N/A | N/A | 7845 | 7860 | TTCTTGCCGTGCACAC | 10 | 211 |
| 905380 | N/A | N/A | 7943 | 7958 | CGTGTGGTTTGCAGGG | 72 | 212 |
| 905412 | N/A | N/A | 8008 | 8023 | TAGGTCTACAAAGAAC | 71 | 213 |
| 905444 | N/A | N/A | 8090 | 8105 | TGGACTGCTCCCTGTA | 13 | 214 |
| 905476 | N/A | N/A | 8177 | 8192 | AGATGTGTTTAGGCAT | 96 | 215 |
| 905508 | N/A | N/A | 8330 | 8345 | CATCATTGGGTTATGA | 37 | 216 |
| 905540 | N/A | N/A | 8388 | 8403 | CACATGCCTGTTGGGT | 48 | 217 |
| 905572 | N/A | N/A | 8466 | 8481 | TTTTCAGCTCAGCACC | 49 | 218 |
| 905604 | N/A | N/A | 8633 | 8648 | AGACTCCAACCCTTTT | 53 | 219 |
| 905636 | N/A | N/A | 8746 | 8761 | TAATTCTATTAGAGGG | 83 | 220 |
| 905668 | N/A | N/A | 8833 | 8848 | TGAAGCTTTAAACTCA | 18 | 221 |
| 905700 | N/A | N/A | 8895 | 8910 | GACTTGTTTTATGGAG | 87 | 222 |
| 905732 | N/A | N/A | 8962 | 8977 | GGAGTGCATAACAGCC | 0 | 223 |

TABLE 4

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 85 | 13 |
| 903429 | 27 | 42 | 520 | 535 | CCCCAAGATATACCGA | 0 | 224 |
| 903461 | 131 | 146 | 624 | 639 | GGAATCTTCCCCTGGC | 51 | 225 |
| 903493 | 256 | 271 | N/A | N/A | GCACCCTCGCTCCAGC | 24 | 226 |
| 903525 | 323 | 338 | 4798 | 4813 | GCAGCCCAGTCACCGA | 0 | 227 |
| 903621 | 563 | 578 | 12654 | 12669 | CTGTACTGCTGGCCTT | 87 | 228 |
| 903653 | 632 | 647 | 12723 | 12738 | GCACGGAGCCTTCTTA | 33 | 229 |
| 903685 | 673 | 688 | 12764 | 12779 | TGGTGGTGCCTTTGTG | 0 | 230 |
| 903717 | 744 | 759 | 12835 | 12850 | TGCCAGACCCATGCCG | 48 | 231 |
| 903749 | 817 | 832 | 12908 | 12923 | CGGTCAAAGCGGCTGT | 71 | 232 |
| 903781 | 853 | 868 | 12944 | 12959 | ACTTCTTTCCGTAGTC | 6 | 233 |
| 903813 | 940 | 955 | 13031 | 13046 | ATATGTTCTCACCCAA | 77 | 234 |
| 903845 | 1012 | 1027 | 13103 | 13118 | TGAGGGCACGGATGTC | 67 | 235 |
| 903877 | 1090 | 1105 | 13181 | 13196 | CAGCTGAGATTGGCTC | 19 | 236 |
| 903909 | 1130 | 1145 | 13221 | 13236 | ATGCTGGGTTCATTAA | 28 | 237 |
| 903941 | 1233 | 1248 | 13324 | 13339 | ATGTAAGTGCTTTGAT | 74 | 238 |
| 903973 | 1348 | 1363 | 13439 | 13454 | ACAGTTCTTGGTCCGC | 92 | 239 |

TABLE 4-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904005 | 1744 | 1759 | 13835 | 13850 | CTCACCCTCTTTATCC | 50 | 240 |
| 904037 | 1827 | 1842 | 13918 | 13933 | CTGCCATCTGCATTAA | 54 | 241 |
| 904069 | 1942 | 1957 | 14033 | 14048 | CCCCCCAATATATTCT | 67 | 242 |
| 904101 | 2340 | 2355 | 14431 | 14446 | GTTCTAACTCTTGGGC | 90 | 243 |
| 904133 | 2416 | 2431 | 14507 | 14522 | ACTTCATTCTTCGGAG | 27 | 244 |
| 904165 | 2514 | 2529 | 14605 | 14620 | ATCATCAGGAAGCCGC | 92 | 245 |
| 904197 | 2614 | 2629 | 14705 | 14720 | TGGCCATGGCCCACCA | 10 | 246 |
| 904229 | 2767 | 2782 | 14858 | 14873 | GAGCTTCCTCCCAATG | 0 | 247 |
| 904261 | 2839 | 2854 | 14930 | 14945 | ATGAGTAGGTGAGTTT | 84 | 248 |
| 904325 | N/A | N/A | 1378 | 1393 | AATCTCATGATTGCAA | 70 | 249 |
| 904357 | N/A | N/A | 872 | 887 | TGTCTCAGCAGTCAAA | 69 | 250 |
| 904389 | N/A | N/A | 2519 | 2534 | TTTGGTTCCTAGAAGA | 25 | 251 |
| 904421 | N/A | N/A | 3417 | 3432 | ACAACTGAGGGTATAT | 80 | 252 |
| 904453 | N/A | N/A | 4366 | 4381 | AGCATGTGTGATAACT | 88 | 253 |
| 904485 | N/A | N/A | 4818 | 4833 | TACCTGGGTCCATGGT | 6 | 254 |
| 904517 | N/A | N/A | 5067 | 5082 | GAGTCATTTGCTAGGT | 90 | 255 |
| 904549 | N/A | N/A | 5175 | 5190 | GCTGGTCAACCTCCTC | 40 | 256 |
| 904581 | N/A | N/A | 5306 | 5321 | GATACATTCCCACAGG | 60 | 257 |
| 904613 | N/A | N/A | 5394 | 5409 | AAGGGAGGTAAGGAGC | 15 | 258 |
| 904645 | N/A | N/A | 5493 | 5508 | GAGGCCCTATTGTGTG | 13 | 259 |
| 904677 | N/A | N/A | 5695 | 5710 | TATTGGGCCTCAGATT | 17 | 260 |
| 904709 | N/A | N/A | 5769 | 5784 | AGCACGAAGCCTCCTC | 60 | 261 |
| 904741 | N/A | N/A | 5813 | 5828 | TCATATTCACCCGATA | 76 | 262 |
| 904773 | N/A | N/A | 5872 | 5887 | TAAACCCAAACAGGCA | 76 | 263 |
| 904805 | N/A | N/A | 5936 | 5951 | CTGTATTCGGAGACCT | 54 | 264 |
| 904837 | N/A | N/A | 5970 | 5985 | CAAAAACCTGGGCAAG | 56 | 265 |
| 904869 | N/A | N/A | 6142 | 6157 | TATGCTTACTCCACAC | 57 | 266 |
| 904901 | N/A | N/A | 6213 | 6228 | TGCCCATGTTTGGTAC | 7 | 267 |
| 904933 | N/A | N/A | 6265 | 6280 | CTCCTTGTCTCACTAA | 50 | 268 |
| 904965 | N/A | N/A | 6333 | 6348 | GCTAAGACCAGTGAGA | 67 | 269 |
| 904997 | N/A | N/A | 6405 | 6420 | TGAAACCACCTGTAGG | 38 | 270 |
| 905029 | N/A | N/A | 6545 | 6560 | AGATGGGTACTTCTGT | 89 | 271 |
| 905061 | N/A | N/A | 6607 | 6622 | CTTTAGAACAGCTGTA | 57 | 272 |
| 905093 | N/A | N/A | 6698 | 6713 | TTCTTGATGTGGTGGG | 92 | 273 |
| 905125 | N/A | N/A | 6797 | 6812 | GCGAGCGATTGTCTTG | 59 | 274 |
| 905157 | N/A | N/A | 6882 | 6897 | GGTTGCCGTGGCAACT | 0 | 275 |

TABLE 4-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 905189 | N/A | N/A | 7043 | 7058 | GGGAGAGTTTTTCCTC | 14 | 276 |
| 905221 | N/A | N/A | 7162 | 7177 | TGAGGCACCTCCATGT | 0 | 277 |
| 905253 | N/A | N/A | 7261 | 7276 | GCAAAGGAGATTCCTC | 61 | 278 |
| 905285 | N/A | N/A | 7343 | 7358 | TCTCCCTTATAGCTTA | 71 | 279 |
| 905317 | N/A | N/A | 7478 | 7493 | GCGAGAGTCACCGCCC | 0 | 280 |
| 905349 | N/A | N/A | 7846 | 7861 | TTTCTTGCCGTGCACA | 17 | 281 |
| 905381 | N/A | N/A | 7957 | 7972 | AGCTGCCACCAAAACG | 25 | 282 |
| 905413 | N/A | N/A | 8009 | 8024 | GTAGGTCTACAAAGAA | 79 | 283 |
| 905445 | N/A | N/A | 8091 | 8106 | CTGGACTGCTCCCTGT | 20 | 284 |
| 905477 | N/A | N/A | 8178 | 8193 | CAGATGTGTTTAGGCA | 97 | 285 |
| 905509 | N/A | N/A | 8331 | 8346 | ACATCATTGGGTTATG | 82 | 286 |
| 905541 | N/A | N/A | 8389 | 8404 | CCACATGCCTGTTGGG | 1 | 287 |
| 905573 | N/A | N/A | 8472 | 8487 | GAATCCTTTTCAGCTC | 63 | 288 |
| 905605 | N/A | N/A | 8634 | 8649 | CAGACTCCAACCCTTT | 49 | 289 |
| 905637 | N/A | N/A | 8747 | 8762 | CTAATTCTATTAGAGG | 35 | 290 |
| 905669 | N/A | N/A | 8835 | 8850 | GCTGAAGCTTTAAACT | 7 | 291 |
| 905701 | N/A | N/A | 8899 | 8914 | GTGGGACTTGTTTTAT | 72 | 292 |
| 905733 | N/A | N/A | 8963 | 8978 | GGGAGTGCATAACAGC | 30 | 293 |

TABLE 5

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 85 | 13 |
| 903430 | 28 | 43 | 521 | 536 | TCCCCAAGATATACCG | 0 | 294 |
| 903462 | 132 | 147 | 625 | 640 | AGGAATCTTCCCCTGG | 0 | 295 |
| 903494 | 257 | 272 | N/A | N/A | TGCACCCTCGCTCCAG | 6 | 296 |
| 903526 | 324 | 339 | 4799 | 4814 | AGCAGCCCAGTCACCG | 0 | 297 |
| 903622 | 564 | 579 | 12655 | 12670 | TCTGTACTGCTGGCCT | 46 | 298 |
| 903654 | 633 | 648 | 12724 | 12739 | GGCACGGAGCCTTCTT | 13 | 299 |
| 903686 | 674 | 689 | 12765 | 12780 | ATGGTGGTGCCTTTGT | 0 | 300 |
| 903718 | 745 | 760 | 12836 | 12851 | GTGCCAGACCCATGCC | 32 | 301 |
| 903750 | 818 | 833 | 12909 | 12924 | CCGGTCAAAGCGGCTG | 0 | 302 |
| 903782 | 854 | 869 | 12945 | 12960 | CACTTCTTTCCGTAGT | 0 | 303 |

TABLE 5-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ SEQ ID NO |
|---|---|---|---|---|---|---|---|
| 903814 | 941 | 956 | 13032 | 13047 | GATATGTTCTCACCCA | 94 | 304 |
| 903846 | 1013 | 1028 | 13104 | 13119 | CTGAGGGCACGGATGT | 65 | 305 |
| 903878 | 1091 | 1106 | 13182 | 13197 | TCAGCTGAGATTGGCT | 0 | 306 |
| 903910 | 1131 | 1146 | 13222 | 13237 | GATGCTGGGTTCATTA | 0 | 307 |
| 903942 | 1235 | 1250 | 13326 | 13341 | TCATGTAAGTGCTTTG | 85 | 308 |
| 903974 | 1349 | 1364 | 13440 | 13455 | CACAGTTCTTGGTCCG | 89 | 309 |
| 904006 | 1747 | 1762 | 13838 | 13853 | TACCTCACCCTCTTTA | 66 | 310 |
| 904038 | 1828 | 1843 | 13919 | 13934 | ACTGCCATCTGCATTA | 0 | 311 |
| 904070 | 1943 | 1958 | 14034 | 14049 | GCCCCCAATATATTC | 29 | 312 |
| 904102 | 2341 | 2356 | 14432 | 14447 | TGTTCTAACTCTTGGG | 90 | 313 |
| 904134 | 2417 | 2432 | 14508 | 14523 | GACTTCATTCTTCGGA | 85 | 314 |
| 904166 | 2515 | 2530 | 14606 | 14621 | CATCATCAGGAAGCCG | 88 | 315 |
| 904198 | 2615 | 2630 | 14706 | 14721 | ATGGCCATGGCCCACC | 0 | 316 |
| 904230 | 2768 | 2783 | 14859 | 14874 | TGAGCTTCCTCCCAAT | 35 | 317 |
| 904262 | 2840 | 2855 | 14931 | 14946 | GATGAGTAGGTGAGTT | 82 | 318 |
| 904326 | N/A | N/A | 1379 | 1394 | GAATCTCATGATTGCA | 68 | 319 |
| 904358 | N/A | N/A | 919 | 934 | AGATGGGCACCCCCAA | 3 | 320 |
| 904390 | N/A | N/A | 2533 | 2548 | TTCCGGGAAGTGACTT | 27 | 321 |
| 904422 | N/A | N/A | 3539 | 3554 | AACACCAATTAGTACA | 64 | 322 |
| 904454 | N/A | N/A | 4384 | 4399 | CAATGACCAGGGCCTG | 30 | 323 |
| 904486 | N/A | N/A | 4822 | 4837 | AGCCTACCTGGGTCCA | 0 | 324 |
| 904518 | N/A | N/A | 5068 | 5083 | TGAGTCATTTGCTAGG | 48 | 325 |
| 904550 | N/A | N/A | 5194 | 5209 | GAGGTGACAGGTCGGG | 33 | 326 |
| 904582 | N/A | N/A | 5307 | 5322 | CGATACATTCCCACAG | 29 | 327 |
| 904614 | N/A | N/A | 5406 | 5421 | ATGGTACAGGAGAAGG | 89 | 328 |
| 904646 | N/A | N/A | 5494 | 5509 | GGAGGCCCTATTGTGT | 10 | 329 |
| 904678 | N/A | N/A | 5696 | 5711 | CTATTGGGCCTCAGAT | 49 | 330 |
| 904710 | N/A | N/A | 5771 | 5786 | ATAGCACGAAGCCTCC | 72 | 331 |
| 904742 | N/A | N/A | 5814 | 5829 | TTCATATTCACCCGAT | 66 | 332 |
| 904774 | N/A | N/A | 5873 | 5888 | GTAAACCCAAACAGGC | 71 | 333 |
| 904806 | N/A | N/A | 5937 | 5952 | CCTGTATTCGGAGACC | 66 | 334 |
| 904838 | N/A | N/A | 5972 | 5987 | ATCAAAAACCTGGGCA | 75 | 335 |
| 904870 | N/A | N/A | 6143 | 6158 | TTATGCTTACTCCACA | 71 | 336 |
| 904902 | N/A | N/A | 6214 | 6229 | ATGCCCATGTTTGGTA | 0 | 337 |
| 904934 | N/A | N/A | 6266 | 6281 | CCTCCTTGTCTCACTA | 0 | 338 |
| 904966 | N/A | N/A | 6334 | 6349 | AGCTAAGACCAGTGAG | 21 | 339 |

TABLE 5-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904998 | N/A | N/A | 6406 | 6421 | CTGAAACCACCTGTAG | 47 | 340 |
| 905030 | N/A | N/A | 6546 | 6561 | CAGATGGGTACTTCTG | 41 | 341 |
| 905062 | N/A | N/A | 6609 | 6624 | GCCTTTAGAACAGCTG | 23 | 342 |
| 905094 | N/A | N/A | 6700 | 6715 | ATTTCTTGATGTGGTG | 98 | 343 |
| 905126 | N/A | N/A | 6798 | 6813 | GGCGAGCGATTGTCTT | 84 | 344 |
| 905158 | N/A | N/A | 6883 | 6898 | TGGTTGCCGTGGCAAC | 0 | 345 |
| 905190 | N/A | N/A | 7059 | 7074 | ATCATCTTGTTTTGGG | 80 | 346 |
| 905222 | N/A | N/A | 7163 | 7178 | TTGAGGCACCTCCATG | 0 | 347 |
| 905254 | N/A | N/A | 7263 | 7278 | ATGCAAAGGAGATTCC | 28 | 348 |
| 905286 | N/A | N/A | 7344 | 7359 | TTCTCCCTTATAGCTT | 33 | 349 |
| 905318 | N/A | N/A | 7479 | 7494 | AGCGAGAGTCACCGCC | 4 | 350 |
| 905350 | N/A | N/A | 7847 | 7862 | GTTTCTTGCCGTGCAC | 22 | 351 |
| 905382 | N/A | N/A | 7960 | 7975 | GTCAGCTGCCACCAAA | 76 | 352 |
| 905414 | N/A | N/A | 8010 | 8025 | GGTAGGTCTACAAAGA | 78 | 353 |
| 905446 | N/A | N/A | 8095 | 8110 | GAGGCTGGACTGCTCC | 0 | 354 |
| 905478 | N/A | N/A | 8179 | 8194 | CCAGATGTGTTTAGGC | 87 | 355 |
| 905510 | N/A | N/A | 8332 | 8347 | CACATCATTGGGTTAT | 92 | 356 |
| 905542 | N/A | N/A | 8390 | 8405 | GCCACATGCCTGTTGG | 0 | 357 |
| 905574 | N/A | N/A | 8481 | 8496 | GAGAGGAATGAATCCT | 37 | 358 |
| 905606 | N/A | N/A | 8644 | 8659 | GAGTCCTCCCCAGACT | 0 | 359 |
| 905638 | N/A | N/A | 8750 | 8765 | GCTCTAATTCTATTAG | 0 | 360 |
| 905670 | N/A | N/A | 8836 | 8851 | TGCTGAAGCTTTAAAC | 13 | 361 |
| 905702 | N/A | N/A | 8900 | 8915 | TGTGGGACTTGTTTTA | 64 | 362 |
| 905734 | N/A | N/A | 8965 | 8980 | GTGGGAGTGCATAACA | 0 | 363 |

TABLE 6

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 80 | 13 |
| 903431 | 29 | 44 | 522 | 537 | GTCCCCAAGATATACC | 2 | 364 |
| 903463 | 135 | 150 | 628 | 643 | CCAAGGAATCTTCCCC | 53 | 365 |
| 903495 | 258 | 273 | N/A | N/A | TTGCACCCTCGCTCCA | 25 | 366 |
| 903527 | 329 | 344 | 4804 | 4819 | GTGCCAGCAGCCCAGT | 0 | 367 |
| 903623 | 565 | 580 | 12656 | 12671 | TTCTGTACTGCTGGCC | 15 | 368 |

TABLE 6-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 903655 | 634 | 649 | 12725 | 12740 | GGGCACGGAGCCTTCT | 0 | 369 |
| 903687 | 675 | 690 | 12766 | 12781 | GATGGTGGTGCCTTTG | 0 | 370 |
| 903719 | 746 | 761 | 12837 | 12852 | GGTGCCAGACCCATGC | 0 | 371 |
| 903751 | 819 | 834 | 12910 | 12925 | CCCGGTCAAAGCGGCT | 0 | 372 |
| 903783 | 855 | 870 | 12946 | 12961 | CCACTTCTTTCCGTAG | 51 | 373 |
| 903815 | 946 | 961 | 13037 | 13052 | AGTTGGATATGTTCTC | 81 | 374 |
| 903847 | 1014 | 1029 | 13105 | 13120 | TCTGAGGGCACGGATG | 24 | 375 |
| 903879 | 1092 | 1107 | 13183 | 13198 | TTCAGCTGAGATTGGC | 49 | 376 |
| 903911 | 1132 | 1147 | 13223 | 13238 | GGATGCTGGGTTCATT | 41 | 377 |
| 903943 | 1236 | 1251 | 13327 | 13342 | CTCATGTAAGTGCTTT | 81 | 378 |
| 903975 | 1351 | 1366 | 13442 | 13457 | GTCACAGTTCTTGGTC | 54 | 379 |
| 904007 | 1748 | 1763 | 13839 | 13854 | TTACCTCACCCTCTTT | 64 | 380 |
| 904039 | 1829 | 1844 | 13920 | 13935 | CACTGCCATCTGCATT | 57 | 381 |
| 904071 | 1944 | 1959 | 14035 | 14050 | GGCCCCCCAATATATT | 0 | 382 |
| 904103 | 2342 | 2357 | 14433 | 14448 | CTGTTCTAACTCTTGG | 93 | 383 |
| 904135 | 2418 | 2433 | 14509 | 14524 | AGACTTCATTCTTCGG | 69 | 384 |
| 904167 | 2516 | 2531 | 14607 | 14622 | CCATCATCAGGAAGCC | 87 | 385 |
| 904199 | 2620 | 2635 | 14711 | 14726 | GGACCATGGCCATGGC | 0 | 386 |
| 904231 | 2772 | 2787 | 14863 | 14878 | GATCTGAGCTTCCTCC | 44 | 387 |
| 904263 | 2841 | 2856 | 14932 | 14947 | TGATGAGTAGGTGAGT | 81 | 388 |
| 904327 | N/A | N/A | 1380 | 1395 | TGAATCTCATGATTGC | 75 | 389 |
| 904359 | N/A | N/A | 1002 | 1017 | GTGTGGCCTGGCCATA | 0 | 390 |
| 904391 | N/A | N/A | 2544 | 2559 | CGGTTGGTCAATTCCG | 0 | 391 |
| 904423 | N/A | N/A | 3741 | 3756 | CAGAGGCTATCAACAA | 90 | 392 |
| 904455 | N/A | N/A | 4391 | 4406 | GTTCTGACAATGACCA | 50 | 393 |
| 904487 | N/A | N/A | 4830 | 4845 | AGGAGGTGAGCCTACC | 0 | 394 |
| 904519 | N/A | N/A | 5069 | 5084 | TTGAGTCATTTGCTAG | 47 | 395 |
| 904551 | N/A | N/A | 5196 | 5211 | GGGAGGTGACAGGTCG | 36 | 396 |
| 904583 | N/A | N/A | 5309 | 5324 | CCCGATACATTCCCAC | 50 | 397 |
| 904615 | N/A | N/A | 5407 | 5422 | CATGGTACAGGAGAAG | 32 | 398 |
| 904647 | N/A | N/A | 5495 | 5510 | GGGAGGCCCTATTGTG | 14 | 399 |
| 904679 | N/A | N/A | 5697 | 5712 | TCTATTGGGCCTCAGA | 15 | 400 |
| 904711 | N/A | N/A | 5772 | 5787 | CATAGCACGAAGCCTC | 70 | 401 |
| 904743 | N/A | N/A | 5815 | 5830 | TTTCATATTCACCCGA | 87 | 402 |
| 904775 | N/A | N/A | 5874 | 5889 | GGTAAACCCAAACAGG | 54 | 403 |
| 904807 | N/A | N/A | 5938 | 5953 | ACCTGTATTCGGAGAC | 58 | 404 |
| 904839 | N/A | N/A | 5974 | 5989 | GCATCAAAAACCTGGG | 52 | 405 |

TABLE 6-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904871 | N/A | N/A | 6144 | 6159 | CTTATGCTTACTCCAC | 85 | 406 |
| 904903 | N/A | N/A | 6215 | 6230 | TATGCCCATGTTTGGT | 51 | 407 |
| 904935 | N/A | N/A | 6268 | 6283 | ACCCTCCTTGTCTCAC | 37 | 408 |
| 904967 | N/A | N/A | 6335 | 6350 | CAGCTAAGACCAGTGA | 65 | 409 |
| 904999 | N/A | N/A | 6407 | 6422 | GCTGAAACCACCTGTA | 66 | 410 |
| 905031 | N/A | N/A | 6547 | 6562 | TCAGATGGGTACTTCT | 89 | 411 |
| 905063 | N/A | N/A | 6610 | 6625 | GGCCTTTAGAACAGCT | 0 | 412 |
| 905095 | N/A | N/A | 6702 | 6717 | GTATTTCTTGATGTGG | 98 | 413 |
| 905127 | N/A | N/A | 6799 | 6814 | GGGCGAGCGATTGTCT | 16 | 414 |
| 905159 | N/A | N/A | 6884 | 6899 | TTGGTTGCCGTGGCAA | 6 | 415 |
| 905191 | N/A | N/A | 7060 | 7075 | GATCATCTTGTTTTGG | 51 | 416 |
| 905223 | N/A | N/A | 7164 | 7179 | CTTGAGGCACCTCCAT | 35 | 417 |
| 905255 | N/A | N/A | 7264 | 7279 | CATGCAAAGGAGATTC | 0 | 418 |
| 905287 | N/A | N/A | 7345 | 7360 | ATTCTCCCTTATAGCT | 15 | 419 |
| 905319 | N/A | N/A | 7480 | 7495 | CAGCGAGAGTCACCGC | 0 | 420 |
| 905351 | N/A | N/A | 7848 | 7863 | TGTTTCTTGCCGTGCA | 34 | 421 |
| 905383 | N/A | N/A | 7963 | 7978 | GAAGTCAGCTGCCACC | 87 | 422 |
| 905415 | N/A | N/A | 8011 | 8026 | TGGTAGGTCTACAAAG | 76 | 423 |
| 905447 | N/A | N/A | 8109 | 8124 | GACCATTCCCAGCAGA | 65 | 424 |
| 905479 | N/A | N/A | 8180 | 8195 | TCCAGATGTGTTTAGG | 83 | 425 |
| 905511 | N/A | N/A | 8333 | 8348 | ACACATCATTGGGTTA | 85 | 426 |
| 905543 | N/A | N/A | 8404 | 8419 | GATCACTTCCATCTGC | 0 | 427 |
| 905575 | N/A | N/A | 8492 | 8507 | ATGGTGCTTTGGAGAG | 5 | 428 |
| 905607 | N/A | N/A | 8649 | 8664 | CAAGAGAGTCCTCCCC | 57 | 429 |
| 905639 | N/A | N/A | 8751 | 8766 | GGCTCTAATTCTATTA | 0 | 430 |
| 905671 | N/A | N/A | 8862 | 8877 | GGAATTGTGTGCCCCC | 43 | 431 |
| 905703 | N/A | N/A | 8902 | 8917 | GATGTGGGACTTGTTT | 82 | 432 |
| 905735 | N/A | N/A | 8966 | 8981 | TGTGGGAGTGCATAAC | 0 | 433 |

TABLE 7

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 86 | 13 |
| 903432 | 30 | 45 | 523 | 538 | AGTCCCCAAGATATAC | 0 | 434 |

TABLE 7-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 903464 | 142 | 157 | N/A | N/A | GCCTCCTCCAAGGAAT | 9 | 435 |
| 903496 | 259 | 274 | N/A | N/A | GTTGCACCCTCGCTCC | 13 | 436 |
| 903528 | 331 | 346 | 4806 | 4821 | TGGTGCCAGCAGCCCA | 0 | 437 |
| 903624 | 566 | 581 | 12657 | 12672 | TTTCTGTACTGCTGGC | 64 | 438 |
| 903656 | 635 | 650 | 12726 | 12741 | AGGGCACGGAGCCTTC | 0 | 439 |
| 903688 | 676 | 691 | 12767 | 12782 | CGATGGTGGTGCCTTT | 0 | 440 |
| 903720 | 747 | 762 | 12838 | 12853 | GGGTGCCAGACCCATG | 5 | 441 |
| 903752 | 820 | 835 | 12911 | 12926 | TCCCGGTCAAAGCGGC | 0 | 442 |
| 903784 | 856 | 871 | 12947 | 12962 | ACCACTTCTTTCCGTA | 23 | 443 |
| 903816 | 947 | 962 | 13038 | 13053 | AAGTTGGATATGTTCT | 74 | 444 |
| 903848 | 1015 | 1030 | 13106 | 13121 | GTCTGAGGGCACGGAT | 37 | 445 |
| 903880 | 1093 | 1108 | 13184 | 13199 | TTTCAGCTGAGATTGG | 56 | 446 |
| 903912 | 1133 | 1148 | 13224 | 13239 | AGGATGCTGGGTTCAT | 66 | 447 |
| 903944 | 1237 | 1252 | 13328 | 13343 | CCTCATGTAAGTGCTT | 70 | 448 |
| 903976 | 1353 | 1368 | 13444 | 13459 | TGGTCACAGTTCTTGG | 89 | 449 |
| 904008 | 1751 | 1766 | 13842 | 13857 | ACTTTACCTCACCCTC | 80 | 450 |
| 904040 | 1830 | 1845 | 13921 | 13936 | GCACTGCCATCTGCAT | 23 | 451 |
| 904072 | 1945 | 1960 | 14036 | 14051 | CGGCCCCCCAATATAT | 0 | 452 |
| 904104 | 2343 | 2358 | 14434 | 14449 | ACTGTTCTAACTCTTG | 90 | 453 |
| 904136 | 2419 | 2434 | 14510 | 14525 | AAGACTTCATTCTTCG | 23 | 454 |
| 904168 | 2517 | 2532 | 14608 | 14623 | ACCATCATCAGGAAGC | 82 | 455 |
| 904200 | 2621 | 2636 | 14712 | 14727 | GGGACCATGGCCATGG | 74 | 456 |
| 904232 | 2773 | 2788 | 14864 | 14879 | AGATCTGAGCTTCCTC | 9 | 457 |
| 904264 | 2842 | 2857 | 14933 | 14948 | TTGATGAGTAGGTGAG | 93 | 458 |
| 904328 | N/A | N/A | 1381 | 1396 | TTGAATCTCATGATTG | 48 | 459 |
| 904360 | N/A | N/A | 1049 | 1064 | TGTTGCCCCCATTGGG | 3 | 460 |
| 904392 | N/A | N/A | 2549 | 2564 | TCTGCCGGTTGGTCAA | 18 | 461 |
| 904424 | N/A | N/A | 3753 | 3768 | GAATGAGCAGGTCAGA | 95 | 462 |
| 904456 | N/A | N/A | 4392 | 4407 | GGTTCTGACAATGACC | 37 | 463 |
| 904488 | N/A | N/A | 4831 | 4846 | GAGGAGGTGAGCCTAC | 35 | 464 |
| 904520 | N/A | N/A | 5070 | 5085 | CTTGAGTCATTTGCTA | 63 | 465 |
| 904552 | N/A | N/A | 5197 | 5212 | CGGGAGGTGACAGGTC | 41 | 466 |
| 904584 | N/A | N/A | 5310 | 5325 | GCCCGATACATTCCCA | 16 | 467 |
| 904616 | N/A | N/A | 5409 | 5424 | CTCATGGTACAGGAGA | 56 | 468 |
| 904648 | N/A | N/A | 5496 | 5511 | AGGGAGGCCCTATTGT | 14 | 469 |
| 904680 | N/A | N/A | 5698 | 5713 | TTCTATTGGGCCTCAG | 90 | 470 |
| 904712 | N/A | N/A | 5773 | 5788 | CCATAGCACGAAGCCT | 72 | 471 |

TABLE 7-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904744 | N/A | N/A | 5816 | 5831 | GTTTCATATTCACCCG | 95 | 472 |
| 904776 | N/A | N/A | 5875 | 5890 | AGGTAAACCCAAACAG | 59 | 473 |
| 904808 | N/A | N/A | 5939 | 5954 | CACCTGTATTCGGAGA | 16 | 474 |
| 904840 | N/A | N/A | 5975 | 5990 | AGCATCAAAAACCTGG | 88 | 475 |
| 904872 | N/A | N/A | 6145 | 6160 | CCTTATGCTTACTCCA | 92 | 476 |
| 904904 | N/A | N/A | 6216 | 6231 | GTATGCCCATGTTTGG | 34 | 477 |
| 904936 | N/A | N/A | 6269 | 6284 | TACCCTCCTTGTCTCA | 54 | 478 |
| 904968 | N/A | N/A | 6336 | 6351 | TCAGCTAAGACCAGTG | 89 | 479 |
| 905000 | N/A | N/A | 6409 | 6424 | TTGCTGAAACCACCTG | 74 | 480 |
| 905032 | N/A | N/A | 6548 | 6563 | ATCAGATGGGTACTTC | 94 | 481 |
| 905064 | N/A | N/A | 6611 | 6626 | AGGCCTTTAGAACAGC | 26 | 482 |
| 905096 | N/A | N/A | 6714 | 6729 | CACTAAATCTGTGTAT | 8 | 483 |
| 905128 | N/A | N/A | 6800 | 6815 | TGGGCGAGCGATTGTC | 87 | 484 |
| 905160 | N/A | N/A | 6885 | 6900 | CTTGGTTGCCGTGGCA | 27 | 485 |
| 905192 | N/A | N/A | 7076 | 7091 | CTGTTATTAAACCACA | 67 | 486 |
| 905224 | N/A | N/A | 7165 | 7180 | CCTTGAGGCACCTCCA | 35 | 487 |
| 905256 | N/A | N/A | 7265 | 7280 | CCATGCAAAGGAGATT | 68 | 488 |
| 905288 | N/A | N/A | 7346 | 7361 | CATTCTCCCTTATAGC | 42 | 489 |
| 905320 | N/A | N/A | 7481 | 7496 | ACAGCGAGAGTCACCG | 78 | 490 |
| 905352 | N/A | N/A | 7849 | 7864 | TTGTTTCTTGCCGTGC | 57 | 491 |
| 905384 | N/A | N/A | 7964 | 7979 | TGAAGTCAGCTGCCAC | 79 | 492 |
| 905416 | N/A | N/A | 8012 | 8027 | ATGGTAGGTCTACAAA | 64 | 493 |
| 905448 | N/A | N/A | 8115 | 8130 | ATTCCTGACCATTCCC | 75 | 494 |
| 905480 | N/A | N/A | 8181 | 8196 | ATCCAGATGTGTTTAG | 86 | 495 |
| 905512 | N/A | N/A | 8334 | 8349 | AACACATCATTGGGTT | 27 | 496 |
| 905544 | N/A | N/A | 8405 | 8420 | TGATCACTTCCATCTG | 0 | 497 |
| 905576 | N/A | N/A | 8493 | 8508 | CATGGTGCTTTGGAGA | 40 | 498 |
| 905608 | N/A | N/A | 8659 | 8674 | CATAAGCCAGCAAGAG | 40 | 499 |
| 905640 | N/A | N/A | 8752 | 8767 | GGGCTCTAATTCTATT | 0 | 500 |
| 905672 | N/A | N/A | 8863 | 8878 | GGGAATTGTGTGCCCC | 24 | 501 |
| 905704 | N/A | N/A | 8903 | 8918 | TGATGTGGGACTTGTT | 92 | 502 |
| 905736 | N/A | N/A | 8967 | 8982 | GTGTGGGAGTGCATAA | 0 | 503 |

TABLE 8

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 80 | 13 |
| 903433 | 31 | 46 | 524 | 539 | CAGTCCCCAAGATATA | 24 | 504 |
| 903465 | 144 | 159 | N/A | N/A | GGGCCTCCTCCAAGGA | 0 | 505 |
| 903497 | 260 | 275 | N/A | N/A | TGTTGCACCCTCGCTC | 42 | 506 |
| 903529 | 332 | 347 | 4807 | 4822 | ATGGTGCCAGCAGCCC | 0 | 507 |
| 903625 | 567 | 582 | 12658 | 12673 | GTTTCTGTACTGCTGG | 72 | 508 |
| 903657 | 636 | 651 | 12727 | 12742 | AAGGGCACGGAGCCTT | 61 | 509 |
| 903689 | 677 | 692 | 12768 | 12783 | GCGATGGTGGTGCCTT | 32 | 510 |
| 903721 | 748 | 763 | 12839 | 12854 | AGGGTGCCAGACCCAT | 0 | 511 |
| 903753 | 821 | 836 | 12912 | 12927 | ATCCCGGTCAAAGCGG | 0 | 512 |
| 903785 | 857 | 872 | 12948 | 12963 | CACCACTTCTTTCCGT | 22 | 513 |
| 903817 | 949 | 964 | 13040 | 13055 | GAAAGTTGGATATGTT | 83 | 514 |
| 903849 | 1016 | 1031 | 13107 | 13122 | CGTCTGAGGGCACGGA | 15 | 515 |
| 903881 | 1094 | 1109 | 13185 | 13200 | CTTTCAGCTGAGATTG | 57 | 516 |
| 903913 | 1134 | 1149 | 13225 | 13240 | CAGGATGCTGGGTTCA | 76 | 517 |
| 903945 | 1238 | 1253 | 13329 | 13344 | CCCTCATGTAAGTGCT | 67 | 518 |
| 903977 | 1354 | 1369 | 13445 | 13460 | GTGGTCACAGTTCTTG | 0 | 519 |
| 904009 | 1752 | 1767 | 13843 | 13858 | AACTTTACCTCACCCT | 87 | 520 |
| 904041 | 1838 | 1853 | 13929 | 13944 | TCCTTGCTGCACTGCC | 94 | 521 |
| 904073 | 1946 | 1961 | 14037 | 14052 | CCGGCCCCCCAATATA | 3 | 522 |
| 904105 | 2345 | 2360 | 14436 | 14451 | CAACTGTTCTAACTCT | 74 | 523 |
| 904137 | 2482 | 2497 | 14573 | 14588 | GCCCCCAGGAGGACAA | 5 | 524 |
| 904169 | 2518 | 2533 | 14609 | 14624 | GACCATCATCAGGAAG | 79 | 525 |
| 904201 | 2672 | 2687 | 14763 | 14778 | CACATACTCTCTGGGA | 47 | 526 |
| 904233 | 2774 | 2789 | 14865 | 14880 | GAGATCTGAGCTTCCT | 88 | 527 |
| 904265 | 2843 | 2858 | 14934 | 14949 | CTTGATGAGTAGGTGA | 78 | 528 |
| 904361 | N/A | N/A | 1052 | 1067 | TTCTGTTGCCCCCATT | 68 | 529 |
| 904393 | N/A | N/A | 2558 | 2573 | CTGGGCGAGTCTGCCG | 0 | 530 |
| 904425 | N/A | N/A | 3756 | 3771 | GTAGAATGAGCAGGTC | 97 | 531 |
| 904457 | N/A | N/A | 4426 | 4441 | AGAGTCTATACACAGA | 75 | 532 |
| 904489 | N/A | N/A | 4851 | 4866 | GAGTAGGAACCAGCAG | 84 | 533 |
| 904521 | N/A | N/A | 5071 | 5086 | ACTTGAGTCATTTGCT | 85 | 534 |
| 904553 | N/A | N/A | 5198 | 5213 | GCGGGAGGTGACAGGT | 33 | 535 |
| 904585 | N/A | N/A | 5311 | 5326 | GGCCCGATACATTCCC | 0 | 536 |
| 904617 | N/A | N/A | 5410 | 5425 | TCTCATGGTACAGGAG | 75 | 537 |
| 904649 | N/A | N/A | 5497 | 5512 | TAGGGAGGCCCTATTG | 14 | 538 |
| 904681 | N/A | N/A | 5699 | 5714 | ATTCTATTGGGCCTCA | 89 | 539 |

TABLE 8-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904713 | N/A | N/A | 5775 | 5790 | CACCATAGCACGAAGC | 90 | 540 |
| 904745 | N/A | N/A | 5817 | 5832 | AGTTTCATATTCACCC | 95 | 541 |
| 904777 | N/A | N/A | 5877 | 5892 | CAAGGTAAACCCAAAC | 30 | 542 |
| 904809 | N/A | N/A | 5940 | 5955 | TCACCTGTATTCGGAG | 32 | 543 |
| 904841 | N/A | N/A | 6017 | 6032 | CTAAAAGCTGATTTGC | 52 | 544 |
| 904873 | N/A | N/A | 6146 | 6161 | TCCTTATGCTTACTCC | 93 | 545 |
| 904905 | N/A | N/A | 6219 | 6234 | CATGTATGCCCATGTT | 61 | 546 |
| 904937 | N/A | N/A | 6270 | 6285 | ATACCCTCCTTGTCTC | 39 | 547 |
| 904969 | N/A | N/A | 6337 | 6352 | TTCAGCTAAGACCAGT | 89 | 548 |
| 905001 | N/A | N/A | 6410 | 6425 | GTTGCTGAAACCACCT | 64 | 549 |
| 905033 | N/A | N/A | 6549 | 6564 | TATCAGATGGGTACTT | 66 | 550 |
| 905065 | N/A | N/A | 6612 | 6627 | GAGGCCTTTAGAACAG | 0 | 551 |
| 905097 | N/A | N/A | 6715 | 6730 | GCACTAAATCTGTGTA | 24 | 552 |
| 905129 | N/A | N/A | 6801 | 6816 | CTGGGCGAGCGATTGT | 61 | 553 |
| 905161 | N/A | N/A | 6886 | 6901 | ACTTGGTTGCCGTGGC | 27 | 554 |
| 905193 | N/A | N/A | 7077 | 7092 | CCTGTTATTAAACCAC | 81 | 555 |
| 905225 | N/A | N/A | 7166 | 7181 | TCCTTGAGGCACCTCC | 32 | 556 |
| 905257 | N/A | N/A | 7266 | 7281 | ACCATGCAAAGGAGAT | 30 | 557 |
| 905289 | N/A | N/A | 7347 | 7362 | GCATTCTCCCTTATAG | 75 | 558 |
| 905321 | N/A | N/A | 7482 | 7497 | GACAGCGAGAGTCACC | 29 | 559 |
| 905353 | N/A | N/A | 7850 | 7865 | ATTGTTTCTTGCCGTG | 55 | 560 |
| 905385 | N/A | N/A | 7967 | 7982 | TCCTGAAGTCAGCTGC | 56 | 561 |
| 905417 | N/A | N/A | 8013 | 8028 | AATGGTAGGTCTACAA | 85 | 562 |
| 905449 | N/A | N/A | 8116 | 8131 | TATTCCTGACCATTCC | 77 | 563 |
| 905481 | N/A | N/A | 8182 | 8197 | AATCCAGATGTGTTTA | 81 | 564 |
| 905513 | N/A | N/A | 8336 | 8351 | TCAACACATCATTGGG | 88 | 565 |
| 905545 | N/A | N/A | 8406 | 8421 | GTGATCACTTCCATCT | 84 | 566 |
| 905577 | N/A | N/A | 8494 | 8509 | CCATGGTGCTTTGGAG | 4 | 567 |
| 905609 | N/A | N/A | 8660 | 8675 | CCATAAGCCAGCAAGA | 53 | 568 |
| 905641 | N/A | N/A | 8753 | 8768 | AGGGCTCTAATTCTAT | 0 | 569 |
| 905673 | N/A | N/A | 8864 | 8879 | AGGGAATTGTGTGCCC | 11 | 570 |
| 905705 | N/A | N/A | 8904 | 8919 | GTGATGTGGGACTTGT | 80 | 571 |
| 905737 | N/A | N/A | 8968 | 8983 | AGTGTGGGAGTGCATA | 0 | 572 |

TABLE 9

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 83 | 13 |
| 903434 | 32 | 47 | 525 | 540 | CCAGTCCCCAAGATAT | 31 | 573 |
| 903466 | 152 | 167 | 2362 | 2377 | TCGCTGCAGGGCCTCC | 26 | 574 |
| 903498 | 261 | 276 | N/A | N/A | TTGTTGCACCCTCGCT | 61 | 575 |
| 903530 | 343 | 358 | N/A | N/A | TCTCTGGGTCCATGGT | 0 | 576 |
| 903626 | 568 | 583 | 12659 | 12674 | AGTTTCTGTACTGCTG | 58 | 577 |
| 903658 | 637 | 652 | 12728 | 12743 | CAAGGGCACGGAGCCT | 1 | 578 |
| 903690 | 678 | 693 | 12769 | 12784 | GGCGATGGTGGTGCCT | 17 | 579 |
| 903722 | 756 | 771 | 12847 | 12862 | CTCTGTGAAGGGTGCC | 39 | 580 |
| 903754 | 822 | 837 | 12913 | 12928 | AATCCCGGTCAAAGCG | 21 | 581 |
| 903786 | 858 | 873 | 12949 | 12964 | CCACCACTTCTTTCCG | 48 | 582 |
| 903818 | 966 | 981 | 13057 | 13072 | ATTGCCAGCTAAGGAA | 51 | 583 |
| 903850 | 1030 | 1045 | 13121 | 13136 | GATTGGCTCTGGCTCG | 56 | 584 |
| 903882 | 1095 | 1110 | 13186 | 13201 | GCTTTCAGCTGAGATT | 6 | 585 |
| 903914 | 1152 | 1167 | 13243 | 13258 | GACTCCTCTGCTCATT | 84 | 586 |
| 903946 | 1239 | 1254 | 13330 | 13345 | CCCCTCATGTAAGTGC | 43 | 587 |
| 903978 | 1359 | 1374 | 13450 | 13465 | GCCCTGTGGTCACAGT | 31 | 588 |
| 904010 | 1753 | 1768 | 13844 | 13859 | AAACTTTACCTCACCC | 71 | 589 |
| 904042 | 1840 | 1855 | 13931 | 13946 | TCTCCTTGCTGCACTG | 92 | 590 |
| 904074 | 1947 | 1962 | 14038 | 14053 | CCCGGCCCCCAATAT | 0 | 591 |
| 904106 | 2346 | 2361 | 14437 | 14452 | CCAACTGTTCTAACTC | 89 | 592 |
| 904138 | 2484 | 2499 | 14575 | 14590 | ATGCCCCAGGAGGAC | 29 | 593 |
| 904170 | 2522 | 2537 | 14613 | 14628 | CAATGACCATCATCAG | 45 | 594 |
| 904202 | 2673 | 2688 | 14764 | 14779 | TCACATACTCTCTGGG | 79 | 595 |
| 904234 | 2775 | 2790 | 14866 | 14881 | AGAGATCTGAGCTTCC | 74 | 596 |
| 904266 | 2844 | 2859 | 14935 | 14950 | GCTTGATGAGTAGGTG | 54 | 597 |
| 904298 | N/A | N/A | 2349 | 2364 | TCCTCCTTGAGCAGGA | 29 | 598 |
| 904362 | N/A | N/A | 1077 | 1092 | TGAACTCCTTGTACCT | 51 | 599 |
| 904394 | N/A | N/A | 2565 | 2580 | GTCCTCCCTGGGCGAG | 33 | 600 |
| 904426 | N/A | N/A | 3793 | 3808 | CCACATTTGAGATTAT | 88 | 601 |
| 904458 | N/A | N/A | 4457 | 4472 | CGGGCAGCCATCTGAT | 0 | 602 |
| 904490 | N/A | N/A | 4870 | 4885 | CACCCTCCATTCTAAG | 0 | 603 |
| 904522 | N/A | N/A | 5072 | 5087 | CACTTGAGTCATTTGC | 84 | 604 |
| 904554 | N/A | N/A | 5199 | 5214 | AGCGGGAGGTGACAGG | 34 | 605 |
| 904586 | N/A | N/A | 5312 | 5327 | AGGCCCGATACATTCC | 26 | 606 |
| 904618 | N/A | N/A | 5411 | 5426 | TTCTCATGGTACAGGA | 65 | 607 |
| 904650 | N/A | N/A | 5498 | 5513 | TTAGGGAGGCCCTATT | 6 | 608 |

TABLE 9-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904682 | N/A | N/A | 5700 | 5715 | AATTCTATTGGGCCTC | 64 | 609 |
| 904714 | N/A | N/A | 5776 | 5791 | TCACCATAGCACGAAG | 86 | 610 |
| 904746 | N/A | N/A | 5819 | 5834 | GCAGTTTCATATTCAC | 96 | 611 |
| 904778 | N/A | N/A | 5887 | 5902 | GATTTCCAACAAGGT | 84 | 612 |
| 904810 | N/A | N/A | 5941 | 5956 | CTCACCTGTATTCGGA | 27 | 613 |
| 904842 | N/A | N/A | 6020 | 6035 | GCACTAAAAGCTGATT | 70 | 614 |
| 904874 | N/A | N/A | 6150 | 6165 | GAAATCCTTATGCTTA | 69 | 615 |
| 904906 | N/A | N/A | 6220 | 6235 | CCATGTATGCCCATGT | 79 | 616 |
| 904938 | N/A | N/A | 6271 | 6286 | CATACCCTCCTTGTCT | 21 | 617 |
| 904970 | N/A | N/A | 6339 | 6354 | AATTCAGCTAAGACCA | 77 | 618 |
| 905002 | N/A | N/A | 6411 | 6426 | AGTTGCTGAAACCACC | 68 | 619 |
| 905034 | N/A | N/A | 6550 | 6565 | ATATCAGATGGGTACT | 74 | 620 |
| 905066 | N/A | N/A | 6613 | 6628 | CGAGGCCTTTAGAACA | 19 | 621 |
| 905098 | N/A | N/A | 6716 | 6731 | GGCACTAAATCTGTGT | 0 | 622 |
| 905130 | N/A | N/A | 6802 | 6817 | GCTGGGCGAGCGATTG | 39 | 623 |
| 905162 | N/A | N/A | 6887 | 6902 | GACTTGGTTGCCGTGG | 79 | 624 |
| 905194 | N/A | N/A | 7078 | 7093 | GCCTGTTATTAAACCA | 52 | 625 |
| 905226 | N/A | N/A | 7167 | 7182 | ATCCTTGAGGCACCTC | 64 | 626 |
| 905258 | N/A | N/A | 7268 | 7283 | CTACCATGCAAAGGAG | 38 | 627 |
| 905290 | N/A | N/A | 7348 | 7363 | TGCATTCTCCCTTATA | 19 | 628 |
| 905322 | N/A | N/A | 7483 | 7498 | AGACAGCGAGAGTCAC | 1 | 629 |
| 905354 | N/A | N/A | 7851 | 7866 | AATTGTTTCTTGCCGT | 41 | 630 |
| 905386 | N/A | N/A | 7973 | 7988 | GATTACTCCTGAAGTC | 53 | 631 |
| 905418 | N/A | N/A | 8015 | 8030 | ATAATGGTAGGTCTAC | 87 | 632 |
| 905450 | N/A | N/A | 8117 | 8132 | ATATTCCTGACCATTC | 72 | 633 |
| 905482 | N/A | N/A | 8183 | 8198 | GAATCCAGATGTGTTT | 80 | 634 |
| 905514 | N/A | N/A | 8337 | 8352 | ATCAACACATCATTGG | 62 | 635 |
| 905546 | N/A | N/A | 8407 | 8422 | AGTGATCACTTCCATC | 0 | 636 |
| 905578 | N/A | N/A | 8495 | 8510 | GCCATGGTGCTTTGGA | 0 | 637 |
| 905610 | N/A | N/A | 8663 | 8678 | CTTCCATAAGCCAGCA | 48 | 638 |
| 905642 | N/A | N/A | 8754 | 8769 | TAGGGCTCTAATTCTA | 32 | 639 |
| 905674 | N/A | N/A | 8865 | 8880 | GAGGGAATTGTGTGCC | 58 | 640 |
| 905706 | N/A | N/A | 8905 | 8920 | TGTGATGTGGGACTTG | 82 | 641 |
| 905738 | N/A | N/A | 8969 | 8984 | AAGTGTGGGAGTGCAT | 0 | 642 |

TABLE 10

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 84 | 13 |
| 903435 | 39 | 54 | 532 | 547 | AGGTCCTCCAGTCCCC | 0 | 643 |
| 903467 | 153 | 168 | 2363 | 2378 | GTCGCTGCAGGGCCTC | 4 | 644 |
| 903499 | 262 | 277 | N/A | N/A | TTTGTTGCACCCTCGC | 91 | 645 |
| 903531 | 345 | 360 | N/A | N/A | GCTCTCTGGGTCCATG | 8 | 646 |
| 903627 | 569 | 584 | 12660 | 12675 | CAGTTTCTGTACTGCT | 14 | 647 |
| 903659 | 638 | 653 | 12729 | 12744 | GCAAGGGCACGGAGCC | 0 | 648 |
| 903691 | 679 | 694 | 12770 | 12785 | TGGCGATGGTGGTGCC | 0 | 649 |
| 903723 | 757 | 772 | 12848 | 12863 | CCTCTGTGAAGGGTGC | 24 | 650 |
| 903755 | 823 | 838 | 12914 | 12929 | TAATCCCGGTCAAAGC | 18 | 651 |
| 903787 | 861 | 876 | 12952 | 12967 | TGTCCACCACTTCTTT | 49 | 652 |
| 903819 | 967 | 982 | 13058 | 13073 | TATTGCCAGCTAAGGA | 33 | 653 |
| 903851 | 1031 | 1046 | 13122 | 13137 | AGATTGGCTCTGGCTC | 87 | 654 |
| 903883 | 1096 | 1111 | 13187 | 13202 | CGCTTTCAGCTGAGAT | 0 | 655 |
| 903915 | 1156 | 1171 | 13247 | 13262 | GCTTGACTCCTCTGCT | 6 | 656 |
| 903947 | 1240 | 1255 | 13331 | 13346 | CCCCCTCATGTAAGTG | 25 | 657 |
| 903979 | 1380 | 1395 | 13471 | 13486 | ATCTCTCCTGGTGGCT | 82 | 658 |
| 904011 | 1754 | 1769 | 13845 | 13860 | TAAACTTTACCTCACC | 65 | 659 |
| 904043 | 1841 | 1856 | 13932 | 13947 | TTCTCCTTGCTGCACT | 89 | 660 |
| 904075 | 1948 | 1963 | 14039 | 14054 | ACCCGGCCCCCAATA | 13 | 661 |
| 904107 | 2347 | 2362 | 14438 | 14453 | TCCAACTGTTCTAACT | 66 | 662 |
| 904139 | 2485 | 2500 | 14576 | 14591 | TATGCCCCAGGAGGA | 24 | 663 |
| 904171 | 2525 | 2540 | 14616 | 14631 | CCCCAATGACCATCAT | 27 | 664 |
| 904203 | 2678 | 2693 | 14769 | 14784 | GGTTCTCACATACTCT | 96 | 665 |
| 904235 | 2776 | 2791 | 14867 | 14882 | TAGAGATCTGAGCTTC | 43 | 666 |
| 904267 | 2845 | 2860 | 14936 | 14951 | AGCTTGATGAGTAGGT | 0 | 667 |
| 904299 | N/A | N/A | 2352 | 2367 | GCCTCCTCCTTGAGCA | 0 | 668 |
| 904363 | N/A | N/A | 1086 | 1101 | GATGACCTCTGAACTC | 65 | 669 |
| 904395 | N/A | N/A | 2566 | 2581 | GGTCCTCCCTGGGCGA | 7 | 670 |
| 904427 | N/A | N/A | 3795 | 3810 | GCCCACATTTGAGATT | 23 | 671 |
| 904459 | N/A | N/A | 4461 | 4476 | AGGACGGGCAGCCATC | 9 | 672 |
| 904491 | N/A | N/A | 4871 | 4886 | CCACCCTCCATTCTAA | 11 | 673 |
| 904523 | N/A | N/A | 5073 | 5088 | CCACTTGAGTCATTTG | 89 | 674 |
| 904555 | N/A | N/A | 5200 | 5215 | GAGCGGGAGGTGACAG | 16 | 675 |
| 904587 | N/A | N/A | 5313 | 5328 | CAGGCCCGATACATTC | 8 | 676 |
| 904619 | N/A | N/A | 5412 | 5427 | ATTCTCATGGTACAGG | 92 | 677 |
| 904651 | N/A | N/A | 5499 | 5514 | CTTAGGGAGGCCCTAT | 3 | 678 |

TABLE 10-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904683 | N/A | N/A | 5701 | 5716 | AAATTCTATTGGGCCT | 19 | 679 |
| 904715 | N/A | N/A | 5777 | 5792 | TTCACCATAGCACGAA | 24 | 680 |
| 904747 | N/A | N/A | 5826 | 5841 | CCTTACTGCAGTTTCA | 91 | 681 |
| 904779 | N/A | N/A | 5889 | 5904 | GGGATTTTCCAACAAG | 42 | 682 |
| 904811 | N/A | N/A | 5942 | 5957 | TCTCACCTGTATTCGG | 28 | 683 |
| 904843 | N/A | N/A | 6021 | 6036 | TGCACTAAAAGCTGAT | 21 | 684 |
| 904875 | N/A | N/A | 6152 | 6167 | CAGAAATCCTTATGCT | 25 | 685 |
| 904907 | N/A | N/A | 6221 | 6236 | TCCATGTATGCCCATG | 77 | 686 |
| 904939 | N/A | N/A | 6279 | 6294 | CACTCAATCATACCCT | 43 | 687 |
| 904971 | N/A | N/A | 6340 | 6355 | CAATTCAGCTAAGACC | 54 | 688 |
| 905003 | N/A | N/A | 6413 | 6428 | GGAGTTGCTGAAACCA | 35 | 689 |
| 905035 | N/A | N/A | 6551 | 6566 | CATATCAGATGGGTAC | 65 | 690 |
| 905067 | N/A | N/A | 6614 | 6629 | ACGAGGCCTTTAGAAC | 49 | 691 |
| 905099 | N/A | N/A | 6720 | 6735 | CTCTGGCACTAAATCT | 38 | 692 |
| 905131 | N/A | N/A | 6803 | 6818 | GGCTGGGCGAGCGATT | 44 | 693 |
| 905163 | N/A | N/A | 6888 | 6903 | TGACTTGGTTGCCGTG | 67 | 694 |
| 905195 | N/A | N/A | 7079 | 7094 | GGCCTGTTATTAAACC | 2 | 695 |
| 905227 | N/A | N/A | 7168 | 7183 | GATCCTTGAGGCACCT | 4 | 696 |
| 905259 | N/A | N/A | 7269 | 7284 | ACTACCATGCAAAGGA | 38 | 697 |
| 905291 | N/A | N/A | 7379 | 7394 | CTCCTTATGTTTTGAA | 81 | 698 |
| 905323 | N/A | N/A | 7484 | 7499 | CAGACAGCGAGAGTCA | 22 | 699 |
| 905355 | N/A | N/A | 7852 | 7867 | AAATTGTTTCTTGCCG | 46 | 700 |
| 905387 | N/A | N/A | 7974 | 7989 | GGATTACTCCTGAAGT | 33 | 701 |
| 905419 | N/A | N/A | 8016 | 8031 | AATAATGGTAGGTCTA | 82 | 702 |
| 905451 | N/A | N/A | 8118 | 8133 | TATATTCCTGACCATT | 63 | 703 |
| 905483 | N/A | N/A | 8184 | 8199 | GGAATCCAGATGTGTT | 86 | 704 |
| 905515 | N/A | N/A | 8338 | 8353 | TATCAACACATCATTG | 37 | 705 |
| 905547 | N/A | N/A | 8408 | 8423 | CAGTGATCACTTCCAT | 38 | 706 |
| 905579 | N/A | N/A | 8516 | 8531 | ACATTGAAACACCAGG | 92 | 707 |
| 905611 | N/A | N/A | 8664 | 8679 | GCTTCCATAAGCCAGC | 35 | 708 |
| 905643 | N/A | N/A | 8755 | 8770 | GTAGGGCTCTAATTCT | 56 | 709 |
| 905675 | N/A | N/A | 8866 | 8881 | AGAGGGAATTGTGTGC | 78 | 710 |
| 905707 | N/A | N/A | 8906 | 8921 | CTGTGATGTGGGACTT | 91 | 711 |
| 905739 | N/A | N/A | 8970 | 8985 | AAAGTGTGGGAGTGCA | 0 | 712 |

TABLE 11

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 93 | 13 |
| 903414 | 12 | 27 | 505 | 520 | AGGAATTCGAAAGGGA | 0 | 713 |
| 903446 | 52 | 67 | 545 | 560 | ATAATAACCAGACAGG | 48 | 714 |
| 903478 | 206 | 221 | N/A | N/A | GCACTCATCCAGATGC | 29 | 715 |
| 903510 | 288 | 303 | 4763 | 4778 | TCCAGTATCTGTCCCA | 57 | 716 |
| 903542 | 397 | 412 | 9060 | 9075 | GTGTGCTCACTTTTTC | 91 | 717 |
| 903638 | 615 | 630 | 12706 | 12721 | GTTATCCTCAAGCTCA | 81 | 718 |
| 903670 | 656 | 671 | 12747 | 12762 | ACCTTCTGAACCCCAT | 85 | 719 |
| 903702 | 729 | 744 | 12820 | 12835 | GACGAGGGTCAGGATG | 51 | 720 |
| 903734 | 789 | 804 | 12880 | 12895 | CATCCCAGGTTCCAAG | 63 | 721 |
| 903766 | 836 | 851 | 12927 | 12942 | ATGGTACTGCTGGTAA | 76 | 722 |
| 903798 | 873 | 888 | 12964 | 12979 | GGCTTGGGCTTGTGTC | 57 | 723 |
| 903830 | 982 | 997 | 13073 | 13088 | GTGTGAGTTGGTAAGT | 98 | 724 |
| 903862 | 1047 | 1062 | 13138 | 13153 | ATGCGGTACTGACTGA | 92 | 725 |
| 903894 | 1107 | 1122 | 13198 | 13213 | CACCTGTTCACCGCTT | 94 | 726 |
| 903926 | 1169 | 1184 | 13260 | 13275 | GCCACATCCGTGAGCT | 25 | 727 |
| 903958 | 1333 | 1348 | 13424 | 13439 | CCTGCAGAATCTTATA | 0 | 728 |
| 903990 | 1393 | 1408 | 13484 | 13499 | CCCTGCCAGGCATATC | 20 | 729 |
| 904022 | 1779 | 1794 | 13870 | 13885 | CCAAAGTCCCTAACAC | 74 | 730 |
| 904054 | 1866 | 1881 | 13957 | 13972 | TATTGCAGGCTCCAAT | 18 | 731 |
| 904086 | 2256 | 2271 | 14347 | 14362 | TCTTCCGTCAATATAT | 79 | 732 |
| 904118 | 2383 | 2398 | 14474 | 14489 | TGGGTCTGTAGTGGAG | 76 | 733 |
| 904150 | 2498 | 2513 | 14589 | 14604 | TGCCTGACTGAGATAT | 64 | 734 |
| 904182 | 2542 | 2557 | 14633 | 14648 | CCATCACATGACAACC | 83 | 735 |
| 904214 | 2712 | 2727 | 14803 | 14818 | CCGGGTAAGAGCGATG | 29 | 736 |
| 904246 | 2793 | 2808 | 14884 | 14899 | CGGCGACAAGACAGCT | 53 | 737 |
| 904278 | N/A | N/A | 448 | 463 | AGCAAACACGCTCCCC | 32 | 738 |
| 904310 | N/A | N/A | 1333 | 1348 | GCAACGCACCCTTCTC | 67 | 739 |
| 904374 | N/A | N/A | 1715 | 1730 | ACAGGCTTCATCATCT | 72 | 740 |
| 904406 | N/A | N/A | 2624 | 2639 | AGCCTCTGCTGAATAT | 25 | 741 |
| 904438 | N/A | N/A | 3956 | 3971 | GATCTTGCCAGATGCC | 38 | 742 |
| 904470 | N/A | N/A | 4584 | 4599 | ATCACTGAGCCCCAT | 55 | 743 |
| 904502 | N/A | N/A | 5016 | 5031 | TCACCCTAAGGAGAGG | 68 | 744 |
| 904534 | N/A | N/A | 5095 | 5110 | ACTTCCCCAAGGATGT | 25 | 745 |
| 904566 | N/A | N/A | 5217 | 5232 | AGGGTCAGCTTGGAGC | 73 | 746 |
| 904598 | N/A | N/A | 5332 | 5347 | GTTAAGCTGGAAGCTG | 41 | 747 |
| 904630 | N/A | N/A | 5455 | 5470 | AGCCGTGTTATATTTG | 88 | 748 |

TABLE 11-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904662 | N/A | N/A | 5580 | 5595 | TGCCCTAACACAGCTG | 8 | 749 |
| 904694 | N/A | N/A | 5742 | 5757 | TTCCCAATTCAGCAAT | 54 | 750 |
| 904726 | N/A | N/A | 5793 | 5808 | TTGTCTCCGACACTTT | 43 | 751 |
| 904758 | N/A | N/A | 5849 | 5864 | AAGTGCAACCAATCAA | 94 | 752 |
| 904790 | N/A | N/A | 5918 | 5933 | CTAAACTCACACTGGC | 67 | 753 |
| 904822 | N/A | N/A | 5953 | 5968 | CTAAGTTCCGGTCTCA | 87 | 754 |
| 904854 | N/A | N/A | 6090 | 6105 | ACTCCACTGGGCCCGA | 16 | 755 |
| 904886 | N/A | N/A | 6191 | 6206 | GCATTGCCCTCCCAAT | 57 | 756 |
| 904918 | N/A | N/A | 6233 | 6248 | CACCACAGCCGTTCCA | 26 | 757 |
| 904950 | N/A | N/A | 6305 | 6320 | CTGGGTCTGACCCACG | 0 | 758 |
| 904982 | N/A | N/A | 6366 | 6381 | CAGGATCCTGACAAAC | 0 | 759 |
| 905014 | N/A | N/A | 6437 | 6452 | CAGGTTCACATGACAG | 77 | 760 |
| 905046 | N/A | N/A | 6582 | 6597 | AACTGCAAGCTATGGG | 91 | 761 |
| 905078 | N/A | N/A | 6628 | 6643 | GACAGGCAATACCTAC | 6 | 762 |
| 905110 | N/A | N/A | 6733 | 6748 | GGATGGAAGGAACCTC | 91 | 763 |
| 905142 | N/A | N/A | 6821 | 6836 | TGAACGCAATGCTGAC | 97 | 764 |
| 905174 | N/A | N/A | 6981 | 6996 | GCTCTCGGCTTCTAAT | 21 | 765 |
| 905206 | N/A | N/A | 7111 | 7126 | CGGCTCTCCACTGTCA | 46 | 766 |
| 905238 | N/A | N/A | 7232 | 7247 | GCACTCTCAGATGGGC | 20 | 767 |
| 905270 | N/A | N/A | 7284 | 7299 | ACAGCATTGAGTACAA | 96 | 768 |
| 905302 | N/A | N/A | 7456 | 7471 | ATCAAGCAGGAAGCTC | 70 | 769 |
| 905334 | N/A | N/A | 7527 | 7542 | CCGGCCACCTCATTCT | 16 | 770 |
| 905366 | N/A | N/A | 7889 | 7904 | CCAGTATGTATTTGTG | 52 | 771 |
| 905398 | N/A | N/A | 7986 | 8001 | CAGTACAGAGCAGGAT | 96 | 772 |
| 905430 | N/A | N/A | 8064 | 8079 | CACATGTTTCAACAGT | 78 | 773 |
| 905462 | N/A | N/A | 8145 | 8160 | TTTAGAAAGGACACGG | 94 | 774 |
| 905494 | N/A | N/A | 8268 | 8283 | AATATCAGAGTGTACC | 94 | 775 |
| 905526 | N/A | N/A | 8373 | 8388 | TCAAACACTTTATACC | 63 | 776 |
| 905558 | N/A | N/A | 8424 | 8439 | GGAAGTGGAAACATCC | 50 | 777 |
| 905590 | N/A | N/A | 8561 | 8576 | GTTGAAGTCACCCAGC | 48 | 778 |
| 905622 | N/A | N/A | 8692 | 8707 | GACTGTGTGAGCACAC | 25 | 779 |
| 905654 | N/A | N/A | 8809 | 8824 | CATTTGGAGATCTGGC | 90 | 780 |
| 905686 | N/A | N/A | 8877 | 8892 | ATTAGTGCTATAGAGG | 87 | 781 |
| 905718 | N/A | N/A | 8945 | 8960 | TTGCATAAGAGATGAC | 84 | 782 |

TABLE 12

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 89 | 13 |
| 903415 | 13 | 28 | 506 | 521 | GAGGAATTCGAAAGGG | 47 | 783 |
| 903447 | 54 | 69 | 547 | 562 | GTATAATAACCAGACA | 30 | 784 |
| 903479 | 207 | 222 | N/A | N/A | TGCACTCATCCAGATG | 15 | 785 |
| 903511 | 289 | 304 | 4764 | 4779 | CTCCAGTATCTGTCCC | 70 | 786 |
| 903671 | 658 | 673 | 12749 | 12764 | GGACCTTCTGAACCCC | 20 | 787 |
| 903703 | 730 | 745 | 12821 | 12836 | CGACGAGGGTCAGGAT | 53 | 788 |
| 903735 | 790 | 805 | 12881 | 12896 | CCATCCCAGGTTCCAA | 51 | 789 |
| 903767 | 837 | 852 | 12928 | 12943 | CATGGTACTGCTGGTA | 83 | 790 |
| 903799 | 891 | 906 | 12982 | 12997 | TTTGATGACCAGGTCG | 74 | 791 |
| 903831 | 983 | 998 | 13074 | 13089 | CGTGTGAGTTGGTAAG | 86 | 792 |
| 903863 | 1048 | 1063 | 13139 | 13154 | CATGCGGTACTGACTG | 44 | 793 |
| 903895 | 1108 | 1123 | 13199 | 13214 | CCACCTGTTCACCGCT | 92 | 794 |
| 903927 | 1171 | 1186 | 13262 | 13277 | GGGCCACATCCGTGAG | 0 | 795 |
| 904023 | 1780 | 1795 | 13871 | 13886 | GCCAAAGTCCCTAACA | 87 | 796 |
| 904087 | 2257 | 2272 | 14348 | 14363 | TTCTTCCGTCAATATA | 91 | 797 |
| 904119 | 2385 | 2400 | 14476 | 14491 | GCTGGGTCTGTAGTGG | 88 | 798 |
| 904151 | 2499 | 2514 | 14590 | 14605 | CTGCCTGACTGAGATA | 86 | 799 |
| 904183 | 2543 | 2558 | 14634 | 14649 | CCCATCACATGACAAC | 85 | 800 |
| 904215 | 2713 | 2728 | 14804 | 14819 | ACCGGGTAAGAGCGAT | 76 | 801 |
| 904247 | 2794 | 2809 | 14885 | 14900 | GCGGCGACAAGACAGC | 24 | 802 |
| 904311 | N/A | N/A | 1336 | 1351 | TCTGCAACGCACCCTT | 54 | 803 |
| 904343 | N/A | N/A | 631 | 646 | TTACCAAGGAATCTTC | 42 | 804 |
| 904375 | N/A | N/A | 1885 | 1900 | CGCCTCCTTCAACCTT | 68 | 805 |
| 904407 | N/A | N/A | 2637 | 2652 | GACCCTGACCTGGAGC | 48 | 806 |
| 904439 | N/A | N/A | 4015 | 4030 | GCACTGGACAGCCTGT | 41 | 807 |
| 904471 | N/A | N/A | 4590 | 4605 | TTGTCTATCACTGAGC | 66 | 808 |
| 904503 | N/A | N/A | 5017 | 5032 | GTCACCCTAAGGAGAG | 40 | 809 |
| 904535 | N/A | N/A | 5104 | 5119 | GCTGATTCCACTTCCC | 66 | 810 |
| 904567 | N/A | N/A | 5221 | 5236 | CCCCAGGGTCAGCTTG | 48 | 811 |
| 904599 | N/A | N/A | 5333 | 5348 | AGTTAAGCTGGAAGCT | 18 | 812 |
| 904631 | N/A | N/A | 5456 | 5471 | TAGCCGTGTTATATTT | 73 | 813 |
| 904663 | N/A | N/A | 5650 | 5665 | TGAACTCAGCCCCTGC | 43 | 814 |
| 904695 | N/A | N/A | 5743 | 5758 | TTTCCCAATTCAGCAA | 63 | 815 |
| 904727 | N/A | N/A | 5794 | 5809 | CTTGTCTCCGACACTT | 81 | 816 |
| 904759 | N/A | N/A | 5850 | 5865 | TAAGTGCAACCAATCA | 92 | 817 |
| 904791 | N/A | N/A | 5919 | 5934 | CCTAAACTCACACTGG | 47 | 818 |

TABLE 12-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904823 | N/A | N/A | 5954 | 5969 | GCTAAGTTCCGGTCTC | 87 | 819 |
| 904855 | N/A | N/A | 6091 | 6106 | AACTCCACTGGGCCCG | 0 | 820 |
| 904887 | N/A | N/A | 6194 | 6209 | ACTGCATTGCCCTCCC | 80 | 821 |
| 904919 | N/A | N/A | 6234 | 6249 | GCACCACAGCCGTTCC | 37 | 822 |
| 904983 | N/A | N/A | 6367 | 6382 | ACAGGATCCTGACAAA | 8 | 823 |
| 905047 | N/A | N/A | 6583 | 6598 | AAACTGCAAGCTATGG | 71 | 824 |
| 905079 | N/A | N/A | 6630 | 6645 | TGGACAGGCAATACCT | 1 | 825 |
| 905143 | N/A | N/A | 6822 | 6837 | ATGAACGCAATGCTGA | 96 | 826 |
| 905175 | N/A | N/A | 6982 | 6997 | TGCTCTCGGCTTCTAA | 65 | 827 |
| 905207 | N/A | N/A | 7112 | 7127 | ACGGCTCTCCACTGTC | 58 | 828 |
| 905239 | N/A | N/A | 7233 | 7248 | GGCACTCTCAGATGGG | 13 | 829 |
| 905271 | N/A | N/A | 7285 | 7300 | CACAGCATTGAGTACA | 88 | 830 |
| 905303 | N/A | N/A | 7459 | 7474 | ACCATCAAGCAGGAAG | 90 | 831 |
| 905335 | N/A | N/A | 7528 | 7543 | CCCGGCCACCTCATTC | 0 | 832 |
| 905367 | N/A | N/A | 7890 | 7905 | ACCAGTATGTATTTGT | 75 | 833 |
| 905399 | N/A | N/A | 7987 | 8002 | TCAGTACAGAGCAGGA | 96 | 834 |
| 905431 | N/A | N/A | 8065 | 8080 | ACACATGTTTCAACAG | 70 | 835 |
| 905463 | N/A | N/A | 8146 | 8161 | TTTTAGAAAGGACACG | 93 | 836 |
| 905495 | N/A | N/A | 8269 | 8284 | AAATATCAGAGTGTAC | 75 | 837 |
| 905527 | N/A | N/A | 8374 | 8389 | GTCAAACACTTTATAC | 52 | 838 |
| 905559 | N/A | N/A | 8442 | 8457 | GTGAGCCTTCCAGGCC | 0 | 839 |
| 905591 | N/A | N/A | 8564 | 8579 | GATGTTGAAGTCACCC | 60 | 840 |
| 905623 | N/A | N/A | 8694 | 8709 | AAGACTGTGTGAGCAC | 54 | 841 |
| 905655 | N/A | N/A | 8811 | 8826 | TACATTTGGAGATCTG | 95 | 842 |
| 905687 | N/A | N/A | 8878 | 8893 | CATTAGTGCTATAGAG | 76 | 843 |
| 905719 | N/A | N/A | 8946 | 8961 | ATTGCATAAGAGATGA | 83 | 844 |

TABLE 13

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 79 | 13 |
| 903416 | 14 | 29 | 507 | 522 | CGAGGAATTCGAAAGG | 22 | 845 |
| 903448 | 55 | 70 | 548 | 563 | TGTATAATAACCAGAC | 27 | 846 |
| 903480 | 208 | 223 | N/A | N/A | GTGCACTCATCCAGAT | 0 | 847 |

TABLE 13-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 903512 | 291 | 306 | 4766 | 4781 | ATCTCCAGTATCTGTC | 20 | 848 |
| 903544 | 403 | 418 | 9066 | 9081 | GATTCTGTGTGCTCAC | 90 | 849 |
| 903640 | 617 | 632 | 12708 | 12723 | ATGTTATCCTCAAGCT | 47 | 850 |
| 903672 | 659 | 674 | 12750 | 12765 | TGGACCTTCTGAACCC | 6 | 851 |
| 903704 | 731 | 746 | 12822 | 12837 | CCGACGAGGGTCAGGA | 25 | 852 |
| 903736 | 793 | 808 | 12884 | 12899 | ACTCCATCCCAGGTTC | 20 | 853 |
| 903768 | 838 | 853 | 12929 | 12944 | CCATGGTACTGCTGGT | 0 | 854 |
| 903800 | 892 | 907 | 12983 | 12998 | TTTTGATGACCAGGTC | 57 | 855 |
| 903832 | 997 | 1012 | 13088 | 13103 | CCTTCCCAATGCCTCG | 78 | 856 |
| 903864 | 1049 | 1064 | 13140 | 13155 | GCATGCGGTACTGACT | 4 | 857 |
| 903896 | 1109 | 1124 | 13200 | 13215 | TCCACCTGTTCACCGC | 78 | 858 |
| 903928 | 1200 | 1215 | 13291 | 13306 | TACATCCAGCACAAGA | 72 | 859 |
| 903960 | 1335 | 1350 | 13426 | 13441 | CGCCTGCAGAATCTTA | 63 | 860 |
| 903992 | 1395 | 1410 | 13486 | 13501 | GCCCCTGCCAGGCATA | 20 | 861 |
| 904024 | 1781 | 1796 | 13872 | 13887 | TGCCAAAGTCCCTAAC | 83 | 862 |
| 904056 | 1872 | 1887 | 13963 | 13978 | TTCCCTTATTGCAGGC | 77 | 863 |
| 904088 | 2258 | 2273 | 14349 | 14364 | ATTCTTCCGTCAATAT | 77 | 864 |
| 904120 | 2386 | 2401 | 14477 | 14492 | GGCTGGGTCTGTAGTG | 66 | 865 |
| 904152 | 2500 | 2515 | 14591 | 14606 | GCTGCCTGACTGAGAT | 33 | 866 |
| 904184 | 2544 | 2559 | 14635 | 14650 | ACCCATCACATGACAA | 80 | 867 |
| 904216 | 2714 | 2729 | 14805 | 14820 | TACCGGGTAAGAGCGA | 84 | 868 |
| 904248 | 2795 | 2810 | 14886 | 14901 | GGCGGCGACAAGACAG | 58 | 869 |
| 904280 | N/A | N/A | 450 | 465 | ACAGCAAACACGCTCC | 18 | 870 |
| 904312 | N/A | N/A | 1338 | 1353 | ATTCTGCAACGCACCC | 61 | 871 |
| 904344 | N/A | N/A | 642 | 657 | CTGTCCCCAACTTACC | 7 | 872 |
| 904376 | N/A | N/A | 1887 | 1902 | TCCGCCTCCTTCAACC | 45 | 873 |
| 904408 | N/A | N/A | 2680 | 2695 | CACCCTGGATCCCATC | 26 | 874 |
| 904440 | N/A | N/A | 4044 | 4059 | CTCTTCATCTTGGTGA | 69 | 875 |
| 904472 | N/A | N/A | 4599 | 4614 | CCAGATTGTTTGTCTA | 62 | 876 |
| 904504 | N/A | N/A | 5018 | 5033 | TGTCACCCTAAGGAGA | 36 | 877 |
| 904536 | N/A | N/A | 5105 | 5120 | CGCTGATTCCACTTCC | 17 | 878 |
| 904568 | N/A | N/A | 5222 | 5237 | ACCCCAGGGTCAGCTT | 25 | 879 |
| 904600 | N/A | N/A | 5334 | 5349 | CAGTTAAGCTGGAAGC | 18 | 880 |
| 904632 | N/A | N/A | 5457 | 5472 | GTAGCCGTGTTATATT | 73 | 881 |
| 904664 | N/A | N/A | 5652 | 5667 | ACTGAACTCAGCCCCT | 50 | 882 |
| 904696 | N/A | N/A | 5744 | 5759 | GTTTCCCAATTCAGCA | 64 | 883 |
| 904728 | N/A | N/A | 5795 | 5810 | CCTTGTCTCCGACACT | 88 | 884 |

TABLE 13-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904760 | N/A | N/A | 5851 | 5866 | GTAAGTGCAACCAATC | 98 | 885 |
| 904792 | N/A | N/A | 5920 | 5935 | CCCTAAACTCACACTG | 28 | 886 |
| 904824 | N/A | N/A | 5955 | 5970 | GGCTAAGTTCCGGTCT | 48 | 887 |
| 904856 | N/A | N/A | 6092 | 6107 | AAACTCCACTGGGCCC | 9 | 888 |
| 904888 | N/A | N/A | 6195 | 6210 | AACTGCATTGCCCTCC | 72 | 889 |
| 904920 | N/A | N/A | 6236 | 6251 | CCGCACCACAGCCGTT | 26 | 890 |
| 904952 | N/A | N/A | 6307 | 6322 | CGCTGGGTCTGACCCA | 22 | 891 |
| 904984 | N/A | N/A | 6368 | 6383 | CACAGGATCCTGACAA | 0 | 892 |
| 905016 | N/A | N/A | 6439 | 6454 | AGCAGGTTCACATGAC | 78 | 893 |
| 905048 | N/A | N/A | 6587 | 6602 | CCTGAAACTGCAAGCT | 41 | 894 |
| 905080 | N/A | N/A | 6631 | 6646 | CTGGACAGGCAATACC | 24 | 895 |
| 905112 | N/A | N/A | 6735 | 6750 | TTGGATGGAAGGAACC | 75 | 896 |
| 905144 | N/A | N/A | 6823 | 6838 | AATGAACGCAATGCTG | 83 | 897 |
| 905176 | N/A | N/A | 6983 | 6998 | GTGCTCTCGGCTTCTA | 59 | 898 |
| 905208 | N/A | N/A | 7113 | 7128 | CACGGCTCTCCACTGT | 30 | 899 |
| 905240 | N/A | N/A | 7234 | 7249 | GGGCACTCTCAGATGG | 44 | 900 |
| 905272 | N/A | N/A | 7286 | 7301 | CCACAGCATTGAGTAC | 58 | 901 |
| 905304 | N/A | N/A | 7460 | 7475 | AACCATCAAGCAGGAA | 70 | 902 |
| 905336 | N/A | N/A | 7532 | 7547 | AGTGCCCGGCCACCTC | 37 | 903 |
| 905368 | N/A | N/A | 7892 | 7907 | GGACCAGTATGTATTT | 34 | 904 |
| 905400 | N/A | N/A | 7988 | 8003 | GTCAGTACAGAGCAGG | 96 | 905 |
| 905432 | N/A | N/A | 8066 | 8081 | CACACATGTTTCAACA | 48 | 906 |
| 905464 | N/A | N/A | 8156 | 8171 | ATTTCCACTATTTTAG | 59 | 907 |
| 905496 | N/A | N/A | 8271 | 8286 | GAAAATATCAGAGTGT | 94 | 908 |
| 905528 | N/A | N/A | 8375 | 8390 | GGTCAAACACTTTATA | 58 | 909 |
| 905560 | N/A | N/A | 8443 | 8458 | AGTGAGCCTTCCAGGC | 11 | 910 |
| 905592 | N/A | N/A | 8565 | 8580 | AGATGTTGAAGTCACC | 67 | 911 |
| 905624 | N/A | N/A | 8704 | 8719 | GGGACACAAGAAGACT | 23 | 912 |
| 905656 | N/A | N/A | 8812 | 8827 | CTACATTTGGAGATCT | 62 | 913 |
| 905688 | N/A | N/A | 8879 | 8894 | TCATTAGTGCTATAGA | 91 | 914 |
| 905720 | N/A | N/A | 8947 | 8962 | CATTGCATAAGAGATG | 19 | 915 |

TABLE 14

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 82 | 13 |
| 903417 | 15 | 30 | 508 | 523 | CCGAGGAATTCGAAAG | 12 | 916 |
| 903449 | 56 | 71 | 549 | 564 | CTGTATAATAACCAGA | 47 | 917 |
| 903481 | 209 | 224 | N/A | N/A | AGTGCACTCATCCAGA | 0 | 918 |
| 903513 | 292 | 307 | 4767 | 4782 | GATCTCCAGTATCTGT | 28 | 919 |
| 903641 | 618 | 633 | 12709 | 12724 | TATGTTATCCTCAAGC | 52 | 920 |
| 903673 | 660 | 675 | 12751 | 12766 | GTGGACCTTCTGAACC | 0 | 921 |
| 903705 | 732 | 747 | 12823 | 12838 | GCCGACGAGGGTCAGG | 11 | 922 |
| 903737 | 794 | 809 | 12885 | 12900 | AACTCCATCCCAGGTT | 0 | 923 |
| 903769 | 839 | 854 | 12930 | 12945 | TCCATGGTACTGCTGG | 0 | 924 |
| 903801 | 893 | 908 | 12984 | 12999 | CTTTTGATGACCAGGT | 60 | 925 |
| 903833 | 999 | 1014 | 13090 | 13105 | GTCCTTCCCAATGCCT | 28 | 926 |
| 903865 | 1050 | 1065 | 13141 | 13156 | GGCATGCGGTACTGAC | 37 | 927 |
| 903897 | 1110 | 1125 | 13201 | 13216 | CTCCACCTGTTCACCG | 57 | 928 |
| 903929 | 1201 | 1216 | 13292 | 13307 | CTACATCCAGCACAAG | 72 | 929 |
| 903961 | 1336 | 1351 | 13427 | 13442 | CCGCCTGCAGAATCTT | 91 | 930 |
| 903993 | 1405 | 1420 | 13496 | 13511 | TTTTGTCCTGGCCCCT | 83 | 931 |
| 904025 | 1782 | 1797 | 13873 | 13888 | ATGCCAAAGTCCCTAA | 96 | 932 |
| 904057 | 1873 | 1888 | 13964 | 13979 | TTTCCCTTATTGCAGG | 77 | 933 |
| 904089 | 2259 | 2274 | 14350 | 14365 | TATTCTTCCGTCAATA | 50 | 934 |
| 904121 | 2401 | 2416 | 14492 | 14507 | GGACATTGAACCTGGG | 86 | 935 |
| 904153 | 2501 | 2516 | 14592 | 14607 | CGCTGCCTGACTGAGA | 58 | 936 |
| 904185 | 2545 | 2560 | 14636 | 14651 | GACCCATCACATGACA | 59 | 937 |
| 904217 | 2715 | 2730 | 14806 | 14821 | TTACCGGGTAAGAGCG | 76 | 938 |
| 904249 | 2796 | 2811 | 14887 | 14902 | GGGCGGCGACAAGACA | 82 | 939 |
| 904281 | N/A | N/A | 451 | 466 | CACAGCAAACACGCTC | 30 | 940 |
| 904313 | N/A | N/A | 1339 | 1354 | CATTCTGCAACGCACC | 54 | 941 |
| 904345 | N/A | N/A | 651 | 666 | GCAGGTCAACTGTCCC | 0 | 942 |
| 904377 | N/A | N/A | 1888 | 1903 | ATCCGCCTCCTTCAAC | 17 | 943 |
| 904409 | N/A | N/A | 2706 | 2721 | ATTCCCCCGACACTTG | 62 | 944 |
| 904441 | N/A | N/A | 4045 | 4060 | ACTCTTCATCTTGGTG | 73 | 945 |
| 904473 | N/A | N/A | 4607 | 4622 | AACCTAAACCAGATTG | 0 | 946 |
| 904505 | N/A | N/A | 5019 | 5034 | GTGTCACCCTAAGGAG | 29 | 947 |
| 904537 | N/A | N/A | 5106 | 5121 | CCGCTGATTCCACTTC | 35 | 948 |
| 904569 | N/A | N/A | 5233 | 5248 | CAGGTGGAAACACCCC | 1 | 949 |
| 904601 | N/A | N/A | 5335 | 5350 | CCAGTTAAGCTGGAAG | 4 | 950 |
| 904633 | N/A | N/A | 5458 | 5473 | GGTAGCCGTGTTATAT | 74 | 951 |

TABLE 14-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904665 | N/A | N/A | 5653 | 5668 | GACTGAACTCAGCCCC | 57 | 952 |
| 904697 | N/A | N/A | 5745 | 5760 | TGTTTCCCAATTCAGC | 67 | 953 |
| 904729 | N/A | N/A | 5796 | 5811 | ACCTTGTCTCCGACAC | 71 | 954 |
| 904761 | N/A | N/A | 5852 | 5867 | TGTAAGTGCAACCAAT | 85 | 955 |
| 904793 | N/A | N/A | 5921 | 5936 | TCCCTAAACTCACACT | 18 | 956 |
| 904825 | N/A | N/A | 5956 | 5971 | AGGCTAAGTTCCGGTC | 35 | 957 |
| 904857 | N/A | N/A | 6093 | 6108 | CAAACTCCACTGGGCC | 16 | 958 |
| 904889 | N/A | N/A | 6196 | 6211 | AAACTGCATTGCCCTC | 64 | 959 |
| 904921 | N/A | N/A | 6237 | 6252 | CCCGCACCACAGCCGT | 44 | 960 |
| 904953 | N/A | N/A | 6308 | 6323 | GCGCTGGGTCTGACCC | 0 | 961 |
| 904985 | N/A | N/A | 6369 | 6384 | CCACAGGATCCTGACA | 14 | 962 |
| 905017 | N/A | N/A | 6512 | 6527 | TAAAGCCAGCTGACAG | 47 | 963 |
| 905049 | N/A | N/A | 6588 | 6603 | CCCTGAAACTGCAAGC | 32 | 964 |
| 905081 | N/A | N/A | 6632 | 6647 | CCTGGACAGGCAATAC | 0 | 965 |
| 905113 | N/A | N/A | 6736 | 6751 | TTTGGATGGAAGGAAC | 71 | 966 |
| 905145 | N/A | N/A | 6824 | 6839 | AAATGAACGCAATGCT | 65 | 967 |
| 905177 | N/A | N/A | 6984 | 6999 | AGTGCTCTCGGCTTCT | 39 | 968 |
| 905209 | N/A | N/A | 7114 | 7129 | ACACGGCTCTCCACTG | 55 | 969 |
| 905241 | N/A | N/A | 7235 | 7250 | TGGGCACTCTCAGATG | 25 | 970 |
| 905273 | N/A | N/A | 7289 | 7304 | ACTCCACAGCATTGAG | 4 | 971 |
| 905305 | N/A | N/A | 7461 | 7476 | AAACCATCAAGCAGGA | 63 | 972 |
| 905337 | N/A | N/A | 7829 | 7844 | ACAAGAGACCTCATTC | 48 | 973 |
| 905369 | N/A | N/A | 7893 | 7908 | GGGACCAGTATGTATT | 21 | 974 |
| 905401 | N/A | N/A | 7990 | 8005 | AAGTCAGTACAGAGCA | 94 | 975 |
| 905433 | N/A | N/A | 8067 | 8082 | CCACACATGTTTCAAC | 62 | 976 |
| 905465 | N/A | N/A | 8158 | 8173 | GAATTTCCACTATTTT | 74 | 977 |
| 905497 | N/A | N/A | 8307 | 8322 | GGTTCAAAAGCAGCAT | 96 | 978 |
| 905529 | N/A | N/A | 8376 | 8391 | GGGTCAAACACTTTAT | 78 | 979 |
| 905561 | N/A | N/A | 8444 | 8459 | AAGTGAGCCTTCCAGG | 30 | 980 |
| 905593 | N/A | N/A | 8566 | 8581 | CAGATGTTGAAGTCAC | 56 | 981 |
| 905625 | N/A | N/A | 8723 | 8738 | CCTATTGTAAGAACAG | 58 | 982 |
| 905657 | N/A | N/A | 8820 | 8835 | TCAGGTGACTACATTT | 89 | 983 |
| 905689 | N/A | N/A | 8880 | 8895 | GTCATTAGTGCTATAG | 95 | 984 |
| 905721 | N/A | N/A | 8948 | 8963 | CCATTGCATAAGAGAT | 84 | 985 |

TABLE 15

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 86 | 13 |
| 903418 | 16 | 31 | 509 | 524 | ACCGAGGAATTCGAAA | 22 | 986 |
| 903450 | 59 | 74 | 552 | 567 | CGTCTGTATAATAACC | 37 | 987 |
| 903482 | 210 | 225 | N/A | N/A | AAGTGCACTCATCCAG | 50 | 988 |
| 903514 | 293 | 308 | 4768 | 4783 | GGATCTCCAGTATCTG | 15 | 989 |
| 903642 | 619 | 634 | 12710 | 12725 | TTATGTTATCCTCAAG | 67 | 990 |
| 903674 | 661 | 676 | 12752 | 12767 | TGTGGACCTTCTGAAC | 16 | 991 |
| 903706 | 733 | 748 | 12824 | 12839 | TGCCGACGAGGGTCAG | 42 | 992 |
| 903738 | 795 | 810 | 12886 | 12901 | CAACTCCATCCCAGGT | 37 | 993 |
| 903770 | 841 | 856 | 12932 | 12947 | AGTCCATGGTACTGCT | 21 | 994 |
| 903802 | 894 | 909 | 12985 | 13000 | GCTTTTGATGACCAGG | 87 | 995 |
| 903834 | 1000 | 1015 | 13091 | 13106 | TGTCCTTCCCAATGCC | 38 | 996 |
| 903866 | 1052 | 1067 | 13143 | 13158 | GAGGCATGCGGTACTG | 53 | 997 |
| 903898 | 1111 | 1126 | 13202 | 13217 | TCTCCACCTGTTCACC | 63 | 998 |
| 903930 | 1204 | 1219 | 13295 | 13310 | AGACTACATCCAGCAC | 81 | 999 |
| 903962 | 1337 | 1352 | 13428 | 13443 | TCCGCCTGCAGAATCT | 76 | 1000 |
| 903994 | 1406 | 1421 | 13497 | 13512 | ATTTTGTCCTGGCCCC | 64 | 1001 |
| 904026 | 1787 | 1802 | 13878 | 13893 | TGGAAATGCCAAAGTC | 97 | 1002 |
| 904058 | 1884 | 1899 | 13975 | 13990 | CAGTTCCCATTTTTCC | 93 | 1003 |
| 904090 | 2260 | 2275 | 14351 | 14366 | CTATTCTTCCGTCAAT | 67 | 1004 |
| 904122 | 2402 | 2417 | 14493 | 14508 | AGGACATTGAACCTGG | 65 | 1005 |
| 904154 | 2502 | 2517 | 14593 | 14608 | CCGCTGCCTGACTGAG | 81 | 1006 |
| 904186 | 2546 | 2561 | 14637 | 14652 | GGACCCATCACATGAC | 55 | 1007 |
| 904218 | 2716 | 2731 | 14807 | 14822 | CTTACCGGGTAAGAGC | 49 | 1008 |
| 904250 | 2797 | 2812 | 14888 | 14903 | TGGGCGGCGACAAGAC | 74 | 1009 |
| 904282 | N/A | N/A | 457 | 472 | ACCAAGCACAGCAAAC | 0 | 1010 |
| 904314 | N/A | N/A | 1341 | 1356 | ACCATTCTGCAACGCA | 68 | 1011 |
| 904346 | N/A | N/A | 655 | 670 | GGAGGCAGGTCAACTG | 5 | 1012 |
| 904378 | N/A | N/A | 2051 | 2066 | TGACCACCTGTCTTGG | 0 | 1013 |
| 904410 | N/A | N/A | 2716 | 2731 | GGTGCCTCGGATTCCC | 9 | 1014 |
| 904442 | N/A | N/A | 4052 | 4067 | GTGCTCAACTCTTCAT | 76 | 1015 |
| 904474 | N/A | N/A | 4615 | 4630 | CCAAGACCAACCTAAA | 29 | 1016 |
| 904506 | N/A | N/A | 5020 | 5035 | CGTGTCACCCTAAGGA | 51 | 1017 |
| 904538 | N/A | N/A | 5107 | 5122 | CCCGCTGATTCCACTT | 36 | 1018 |
| 904570 | N/A | N/A | 5234 | 5249 | TCAGGTGGAAACACCC | 11 | 1019 |
| 904602 | N/A | N/A | 5336 | 5351 | TCCAGTTAAGCTGGAA | 0 | 1020 |
| 904634 | N/A | N/A | 5460 | 5475 | CAGGTAGCCGTGTTAT | 41 | 1021 |

TABLE 15-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904666 | N/A | N/A | 5654 | 5669 | TGACTGAACTCAGCCC | 43 | 1022 |
| 904698 | N/A | N/A | 5747 | 5762 | GCTGTTTCCCAATTCA | 57 | 1023 |
| 904730 | N/A | N/A | 5797 | 5812 | AACCTTGTCTCCGACA | 46 | 1024 |
| 904762 | N/A | N/A | 5853 | 5868 | TTGTAAGTGCAACCAA | 76 | 1025 |
| 904794 | N/A | N/A | 5925 | 5940 | GACCTCCCTAAACTCA | 13 | 1026 |
| 904826 | N/A | N/A | 5957 | 5972 | AAGGCTAAGTTCCGGT | 47 | 1027 |
| 904858 | N/A | N/A | 6104 | 6119 | GACAAGAACCCCAAAC | 0 | 1028 |
| 904890 | N/A | N/A | 6197 | 6212 | AAAACTGCATTGCCCT | 72 | 1029 |
| 904922 | N/A | N/A | 6238 | 6253 | ACCCGCACCACAGCCG | 12 | 1030 |
| 904954 | N/A | N/A | 6320 | 6335 | AGATCCAACTCGGCGC | 7 | 1031 |
| 904986 | N/A | N/A | 6370 | 6385 | CCCACAGGATCCTGAC | 25 | 1032 |
| 905018 | N/A | N/A | 6514 | 6529 | CTTAAAGCCAGCTGAC | 25 | 1033 |
| 905050 | N/A | N/A | 6590 | 6605 | CCCCCTGAAACTGCAA | 34 | 1034 |
| 905082 | N/A | N/A | 6633 | 6648 | TCCTGGACAGGCAATA | 32 | 1035 |
| 905114 | N/A | N/A | 6739 | 6754 | AGGTTTGGATGGAAGG | 90 | 1036 |
| 905146 | N/A | N/A | 6825 | 6840 | GAAATGAACGCAATGC | 87 | 1037 |
| 905178 | N/A | N/A | 6985 | 7000 | GAGTGCTCTCGGCTTC | 47 | 1038 |
| 905210 | N/A | N/A | 7115 | 7130 | TACACGGCTCTCCACT | 73 | 1039 |
| 905242 | N/A | N/A | 7236 | 7251 | TTGGGCACTCTCAGAT | 8 | 1040 |
| 905274 | N/A | N/A | 7290 | 7305 | AACTCCACAGCATTGA | 53 | 1041 |
| 905306 | N/A | N/A | 7466 | 7481 | GCCCAAAACCATCAAG | 3 | 1042 |
| 905338 | N/A | N/A | 7830 | 7845 | CACAAGAGACCTCATT | 15 | 1043 |
| 905370 | N/A | N/A | 7917 | 7932 | TATGGAATTGCAGATA | 85 | 1044 |
| 905402 | N/A | N/A | 7991 | 8006 | CAAGTCAGTACAGAGC | 93 | 1045 |
| 905434 | N/A | N/A | 8068 | 8083 | CCCACACATGTTTCAA | 58 | 1046 |
| 905466 | N/A | N/A | 8159 | 8174 | AGAATTTCCACTATTT | 82 | 1047 |
| 905498 | N/A | N/A | 8308 | 8323 | TGGTTCAAAAGCAGCA | 90 | 1048 |
| 905530 | N/A | N/A | 8377 | 8392 | TGGGTCAAACACTTTA | 63 | 1049 |
| 905562 | N/A | N/A | 8445 | 8460 | GAAGTGAGCCTTCCAG | 60 | 1050 |
| 905594 | N/A | N/A | 8567 | 8582 | CCAGATGTTGAAGTCA | 76 | 1051 |
| 905626 | N/A | N/A | 8724 | 8739 | TCCTATTGTAAGAACA | 54 | 1052 |
| 905658 | N/A | N/A | 8821 | 8836 | CTCAGGTGACTACATT | 87 | 1053 |
| 905690 | N/A | N/A | 8881 | 8896 | AGTCATTAGTGCTATA | 90 | 1054 |
| 905722 | N/A | N/A | 8949 | 8964 | GCCATTGCATAAGAGA | 29 | 1055 |

TABLE 16

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 903419 | 17 | 32 | 510 | 525 | TACCGAGGAATTCGAA | 13 | 1056 |
| 903451 | 73 | 88 | 566 | 581 | CACCTCCAGTTATGCG | 51 | 1057 |
| 903483 | 211 | 226 | N/A | N/A | AAAGTGCACTCATCCA | 71 | 1058 |
| 903515 | 294 | 309 | 4769 | 4784 | AGGATCTCCAGTATCT | 24 | 1059 |
| 903643 | 620 | 635 | 12711 | 12726 | CTTATGTTATCCTCAA | 81 | 1060 |
| 903675 | 662 | 677 | 12753 | 12768 | TTGTGGACCTTCTGAA | 58 | 1061 |
| 903707 | 734 | 749 | 12825 | 12840 | ATGCCGACGAGGGTCA | 49 | 1062 |
| 903739 | 801 | 816 | 12892 | 12907 | GATTCCCAACTCCATC | 10 | 1063 |
| 903771 | 842 | 857 | 12933 | 12948 | TAGTCCATGGTACTGC | 4 | 1064 |
| 903803 | 896 | 911 | 12987 | 13002 | AGGCTTTTGATGACCA | 24 | 1065 |
| 903835 | 1001 | 1016 | 13092 | 13107 | ATGTCCTTCCCAATGC | 32 | 1066 |
| 903867 | 1053 | 1068 | 13144 | 13159 | TGAGGCATGCGGTACT | 88 | 1067 |
| 903899 | 1115 | 1130 | 13206 | 13221 | ACCCTCTCCACCTGTT | 41 | 1068 |
| 903931 | 1205 | 1220 | 13296 | 13311 | TAGACTACATCCAGCA | 72 | 1069 |
| 903963 | 1338 | 1353 | 13429 | 13444 | GTCCGCCTGCAGAATC | 82 | 1070 |
| 903995 | 1701 | 1716 | 13792 | 13807 | AAAAGCGATGGCTCAC | 57 | 1071 |
| 904027 | 1791 | 1806 | 13882 | 13897 | GCTATGGAAATGCCAA | 90 | 1072 |
| 904059 | 1886 | 1901 | 13977 | 13992 | TCCAGTTCCCATTTTT | 90 | 1073 |
| 904091 | 2264 | 2279 | 14355 | 14370 | CTCTCTATTCTTCCGT | 92 | 1074 |
| 904123 | 2404 | 2419 | 14495 | 14510 | GGAGGACATTGAACCT | 62 | 1075 |
| 904155 | 2503 | 2518 | 14594 | 14609 | GCCGCTGCCTGACTGA | 48 | 1076 |
| 904187 | 2589 | 2604 | 14680 | 14695 | CAGTGTTCAAGCAGGG | 83 | 1077 |
| 904219 | 2717 | 2732 | 14808 | 14823 | ACTTACCGGGTAAGAG | 49 | 1078 |
| 904251 | 2798 | 2813 | 14889 | 14904 | CTGGGCGGCGACAAGA | 39 | 1079 |
| 904283 | N/A | N/A | 458 | 473 | GACCAAGCACAGCAAA | 0 | 1080 |
| 904315 | N/A | N/A | 1342 | 1357 | CACCATTCTGCAACGC | 74 | 1081 |
| 904347 | N/A | N/A | 767 | 782 | CAATCAGACTCAAGCC | 19 | 1082 |
| 904379 | N/A | N/A | 2053 | 2068 | CGTGACCACCTGTCTT | 16 | 1083 |
| 904411 | N/A | N/A | 2721 | 2736 | GAGCTGGTGCCTCGGA | 30 | 1084 |
| 904443 | N/A | N/A | 4081 | 4096 | CCTCATTGCAAATCCT | 96 | 1085 |
| 904475 | N/A | N/A | 4648 | 4663 | GCTCTGCAAATCTCTC | 15 | 1086 |
| 904507 | N/A | N/A | 5021 | 5036 | CCGTGTCACCCTAAGG | 54 | 1087 |
| 904539 | N/A | N/A | 5108 | 5123 | CCCCGCTGATTCCACT | 16 | 1088 |
| 904571 | N/A | N/A | 5235 | 5250 | CTCAGGTGGAAACACC | 34 | 1089 |
| 904603 | N/A | N/A | 5337 | 5352 | GTCCAGTTAAGCTGGA | 9 | 1090 |
| 904635 | N/A | N/A | 5461 | 5476 | CCAGGTAGCCGTGTTA | 74 | 1091 |
| 904667 | N/A | N/A | 5655 | 5670 | ATGACTGAACTCAGCC | 32 | 1092 |

TABLE 16-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904699 | N/A | N/A | 5757 | 5772 | CCTCCAGTTTGCTGTT | 48 | 1093 |
| 904731 | N/A | N/A | 5798 | 5813 | AAACCTTGTCTCCGAC | 66 | 1094 |
| 904763 | N/A | N/A | 5854 | 5869 | TTTGTAAGTGCAACCA | 96 | 1095 |
| 904795 | N/A | N/A | 5926 | 5941 | AGACCTCCCTAAACTC | 8 | 1096 |
| 904827 | N/A | N/A | 5958 | 5973 | CAAGGCTAAGTTCCGG | 64 | 1097 |
| 904859 | N/A | N/A | 6106 | 6121 | AAGACAAGAACCCCAA | 68 | 1098 |
| 904891 | N/A | N/A | 6198 | 6213 | CAAAACTGCATTGCCC | 50 | 1099 |
| 904923 | N/A | N/A | 6242 | 6257 | ACCCACCCGCACCACA | 16 | 1100 |
| 904955 | N/A | N/A | 6321 | 6336 | GAGATCCAACTCGGCG | 11 | 1101 |
| 904987 | N/A | N/A | 6371 | 6386 | GCCCACAGGATCCTGA | 0 | 1102 |
| 905051 | N/A | N/A | 6592 | 6607 | AACCCCTGAAACTGC | 65 | 1103 |
| 905083 | N/A | N/A | 6634 | 6649 | TTCCTGGACAGGCAAT | 31 | 1104 |
| 905115 | N/A | N/A | 6740 | 6755 | CAGGTTTGGATGGAAG | 74 | 1105 |
| 905147 | N/A | N/A | 6826 | 6841 | GGAAATGAACGCAATG | 91 | 1106 |
| 905179 | N/A | N/A | 6986 | 7001 | TGAGTGCTCTCGGCTT | 62 | 1107 |
| 905211 | N/A | N/A | 7116 | 7131 | GTACACGGCTCTCCAC | 7 | 1108 |
| 905243 | N/A | N/A | 7237 | 7252 | CTTGGGCACTCTCAGA | 44 | 1109 |
| 905275 | N/A | N/A | 7291 | 7306 | AAACTCCACAGCATTG | 30 | 1110 |
| 905307 | N/A | N/A | 7467 | 7482 | CGCCCAAAACCATCAA | 44 | 1111 |
| 905339 | N/A | N/A | 7833 | 7848 | ACACACAAGAGACCTC | 0 | 1112 |
| 905371 | N/A | N/A | 7918 | 7933 | TTATGGAATTGCAGAT | 93 | 1113 |
| 905403 | N/A | N/A | 7992 | 8007 | TCAAGTCAGTACAGAG | 92 | 1114 |
| 905435 | N/A | N/A | 8070 | 8085 | CACCCACACATGTTTC | 49 | 1115 |
| 905467 | N/A | N/A | 8160 | 8175 | CAGAATTTCCACTATT | 85 | 1116 |
| 905499 | N/A | N/A | 8309 | 8324 | TTGGTTCAAAAGCAGC | 92 | 1117 |
| 905531 | N/A | N/A | 8378 | 8393 | TTGGGTCAAACACTTT | 69 | 1118 |
| 905563 | N/A | N/A | 8448 | 8463 | CATGAAGTGAGCCTTC | 56 | 1119 |
| 905595 | N/A | N/A | 8568 | 8583 | GCCAGATGTTGAAGTC | 34 | 1120 |
| 905627 | N/A | N/A | 8725 | 8740 | GTCCTATTGTAAGAAC | 24 | 1121 |
| 905659 | N/A | N/A | 8822 | 8837 | ACTCAGGTGACTACAT | 71 | 1122 |
| 905691 | N/A | N/A | 8882 | 8897 | GAGTCATTAGTGCTAT | 92 | 1123 |
| 905723 | N/A | N/A | 8951 | 8966 | CAGCCATTGCATAAGA | 46 | 1124 |

TABLE 17

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 84 | 13 |
| 903420 | 18 | 33 | 511 | 526 | ATACCGAGGAATTCGA | 5 | 1125 |
| 903452 | 74 | 89 | 567 | 582 | CCACCTCCAGTTATGC | 70 | 1126 |
| 903484 | 212 | 227 | 4505 | 4520 | AAAAGTGCACTCATCC | 65 | 1127 |
| 903516 | 295 | 310 | 4770 | 4785 | GAGGATCTCCAGTATC | 60 | 1128 |
| 903644 | 623 | 638 | 12714 | 12729 | CTTCTTATGTTATCCT | 90 | 1129 |
| 903676 | 663 | 678 | 12754 | 12769 | TTTGTGGACCTTCTGA | 76 | 1130 |
| 903708 | 735 | 750 | 12826 | 12841 | CATGCCGACGAGGGTC | 25 | 1131 |
| 903740 | 805 | 820 | 12896 | 12911 | CTGTGATTCCCAACTC | 66 | 1132 |
| 903772 | 843 | 858 | 12934 | 12949 | GTAGTCCATGGTACTG | 15 | 1133 |
| 903804 | 897 | 912 | 12988 | 13003 | AAGGCTTTTGATGACC | 64 | 1134 |
| 903836 | 1002 | 1017 | 13093 | 13108 | GATGTCCTTCCCAATG | 29 | 1135 |
| 903868 | 1054 | 1069 | 13145 | 13160 | CTGAGGCATGCGGTAC | 78 | 1136 |
| 903900 | 1116 | 1131 | 13207 | 13222 | AACCCTCTCCACCTGT | 48 | 1137 |
| 903932 | 1206 | 1221 | 13297 | 13312 | GTAGACTACATCCAGC | 63 | 1138 |
| 903964 | 1339 | 1354 | 13430 | 13445 | GGTCCGCCTGCAGAAT | 70 | 1139 |
| 903996 | 1706 | 1721 | 13797 | 13812 | GGGTCAAAAGCGATGG | 94 | 1140 |
| 904028 | 1792 | 1807 | 13883 | 13898 | AGCTATGGAAATGCCA | 62 | 1141 |
| 904060 | 1888 | 1903 | 13979 | 13994 | TCTCCAGTTCCCATTT | 73 | 1142 |
| 904092 | 2270 | 2285 | 14361 | 14376 | AGCCTCCTCTCTATTC | 49 | 1143 |
| 904124 | 2405 | 2420 | 14496 | 14511 | CGGAGGACATTGAACC | 89 | 1144 |
| 904156 | 2504 | 2519 | 14595 | 14610 | AGCCGCTGCCTGACTG | 54 | 1145 |
| 904188 | 2590 | 2605 | 14681 | 14696 | TCAGTGTTCAAGCAGG | 92 | 1146 |
| 904220 | 2718 | 2733 | 14809 | 14824 | TACTTACCGGGTAAGA | 47 | 1147 |
| 904252 | 2799 | 2814 | 14890 | 14905 | CCTGGGCGGCGACAAG | 53 | 1148 |
| 904284 | N/A | N/A | 459 | 474 | TGACCAAGCACAGCAA | 10 | 1149 |
| 904316 | N/A | N/A | 1343 | 1358 | GCACCATTCTGCAACG | 29 | 1150 |
| 904348 | N/A | N/A | 801 | 816 | TCTATAGTTTAAGAGC | 6 | 1151 |
| 904380 | N/A | N/A | 2437 | 2452 | TCCCGCCTCAGGGCTC | 22 | 1152 |
| 904412 | N/A | N/A | 2788 | 2803 | ACACCATCTCATGAGC | 59 | 1153 |
| 904444 | N/A | N/A | 4200 | 4215 | GTTTTACAATAGTGC | 97 | 1154 |
| 904476 | N/A | N/A | 4667 | 4682 | GCTTGCTTGAGCAGCC | 16 | 1155 |
| 904508 | N/A | N/A | 5022 | 5037 | GCCGTGTCACCCTAAG | 65 | 1156 |
| 904540 | N/A | N/A | 5109 | 5124 | CCCCCGCTGATTCCAC | 43 | 1157 |
| 904572 | N/A | N/A | 5236 | 5251 | CCTCAGGTGGAAACAC | 0 | 1158 |
| 904604 | N/A | N/A | 5338 | 5353 | GGTCCAGTTAAGCTGG | 12 | 1159 |
| 904636 | N/A | N/A | 5462 | 5477 | GCCAGGTAGCCGTGTT | 61 | 1160 |

TABLE 17-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904668 | N/A | N/A | 5656 | 5671 | GATGACTGAACTCAGC | 63 | 1161 |
| 904700 | N/A | N/A | 5760 | 5775 | CCTCCTCCAGTTTGCT | 50 | 1162 |
| 904732 | N/A | N/A | 5799 | 5814 | TAAACCTTGTCTCCGA | 87 | 1163 |
| 904764 | N/A | N/A | 5855 | 5870 | TTTTGTAAGTGCAACC | 94 | 1164 |
| 904796 | N/A | N/A | 5927 | 5942 | GAGACCTCCCTAAACT | 26 | 1165 |
| 904828 | N/A | N/A | 5959 | 5974 | GCAAGGCTAAGTTCCG | 97 | 1166 |
| 904860 | N/A | N/A | 6108 | 6123 | CAAAGACAAGAACCCC | 68 | 1167 |
| 904892 | N/A | N/A | 6199 | 6214 | ACAAAACTGCATTGCC | 50 | 1168 |
| 904924 | N/A | N/A | 6254 | 6269 | ACTAAACCCCACACCC | 6 | 1169 |
| 904956 | N/A | N/A | 6322 | 6337 | TGAGATCCAACTCGGC | 65 | 1170 |
| 904988 | N/A | N/A | 6372 | 6387 | GGCCCACAGGATCCTG | 0 | 1171 |
| 905020 | N/A | N/A | 6536 | 6551 | CTTCTGTTAGATACAA | 93 | 1172 |
| 905052 | N/A | N/A | 6593 | 6608 | TAACCCCTGAAACTG | 61 | 1173 |
| 905084 | N/A | N/A | 6635 | 6650 | ATTCCTGGACAGGCAA | 62 | 1174 |
| 905116 | N/A | N/A | 6741 | 6756 | CCAGGTTTGGATGGAA | 73 | 1175 |
| 905148 | N/A | N/A | 6827 | 6842 | GGGAAATGAACGCAAT | 89 | 1176 |
| 905180 | N/A | N/A | 6987 | 7002 | CTGAGTGCTCTCGGCT | 77 | 1177 |
| 905212 | N/A | N/A | 7117 | 7132 | GGTACACGGCTCTCCA | 29 | 1178 |
| 905244 | N/A | N/A | 7238 | 7253 | TCTTGGGCACTCTCAG | 80 | 1179 |
| 905276 | N/A | N/A | 7298 | 7313 | ATGTCTCAAACTCCAC | 90 | 1180 |
| 905308 | N/A | N/A | 7468 | 7483 | CCGCCCAAAACCATCA | 58 | 1181 |
| 905340 | N/A | N/A | 7835 | 7850 | GCACACACAAGAGACC | 13 | 1182 |
| 905372 | N/A | N/A | 7921 | 7936 | GAATTATGGAATTGCA | 90 | 1183 |
| 905404 | N/A | N/A | 7994 | 8009 | ACTCAAGTCAGTACAG | 87 | 1184 |
| 905436 | N/A | N/A | 8077 | 8092 | GTAATCACACCCACAC | 50 | 1185 |
| 905468 | N/A | N/A | 8162 | 8177 | TTCAGAATTTCCACTA | 92 | 1186 |
| 905500 | N/A | N/A | 8310 | 8325 | ATTGGTTCAAAAGCAG | 85 | 1187 |
| 905532 | N/A | N/A | 8379 | 8394 | GTTGGGTCAAACACTT | 71 | 1188 |
| 905564 | N/A | N/A | 8449 | 8464 | ACATGAAGTGAGCCTT | 88 | 1189 |
| 905596 | N/A | N/A | 8620 | 8635 | TTTGGCACCTTCACCT | 53 | 1190 |
| 905628 | N/A | N/A | 8738 | 8753 | TTAGAGGGCTAGTGTC | 82 | 1191 |
| 905660 | N/A | N/A | 8823 | 8838 | AACTCAGGTGACTACA | 68 | 1192 |
| 905692 | N/A | N/A | 8883 | 8898 | GGAGTCATTAGTGCTA | 82 | 1193 |
| 905724 | N/A | N/A | 8952 | 8967 | ACAGCCATTGCATAAG | 50 | 1194 |

TABLE 18

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 87 | 13 |
| 903421 | 19 | 34 | 512 | 527 | TATACCGAGGAATTCG | 23 | 1195 |
| 903453 | 75 | 90 | 568 | 583 | CCCACCTCCAGTTATG | 45 | 1196 |
| 903485 | 217 | 232 | 4510 | 4525 | CAAGGAAAAGTGCACT | 33 | 1197 |
| 903517 | 296 | 311 | 4771 | 4786 | TGAGGATCTCCAGTAT | 69 | 1198 |
| 903613 | 527 | 542 | 12618 | 12633 | TTCATGATCATTTGTC | 88 | 1199 |
| 903645 | 624 | 639 | 12715 | 12730 | CCTTCTTATGTTATCC | 82 | 1200 |
| 903677 | 664 | 679 | 12755 | 12770 | CTTTGTGGACCTTCTG | 74 | 1201 |
| 903709 | 736 | 751 | 12827 | 12842 | CCATGCCGACGAGGGT | 25 | 1202 |
| 903741 | 806 | 821 | 12897 | 12912 | GCTGTGATTCCCAACT | 59 | 1203 |
| 903773 | 844 | 859 | 12935 | 12950 | CGTAGTCCATGGTACT | 25 | 1204 |
| 903805 | 898 | 913 | 12989 | 13004 | CAAGGCTTTTGATGAC | 88 | 1205 |
| 903837 | 1003 | 1018 | 13094 | 13109 | GGATGTCCTTCCCAAT | 46 | 1206 |
| 903869 | 1079 | 1094 | 13170 | 13185 | GGCTCAGTGACCCGGG | 17 | 1207 |
| 903901 | 1119 | 1134 | 13210 | 13225 | ATTAACCCTCTCCACC | 27 | 1208 |
| 903933 | 1207 | 1222 | 13298 | 13313 | GGTAGACTACATCCAG | 59 | 1209 |
| 903965 | 1340 | 1355 | 13431 | 13446 | TGGTCCGCCTGCAGAA | 83 | 1210 |
| 904029 | 1793 | 1808 | 13884 | 13899 | CAGCTATGGAAATGCC | 86 | 1211 |
| 904061 | 1890 | 1905 | 13981 | 13996 | ACTCTCCAGTTCCCAT | 88 | 1212 |
| 904093 | 2272 | 2287 | 14363 | 14378 | CAAGCCTCCTCTCTAT | 81 | 1213 |
| 904125 | 2407 | 2422 | 14498 | 14513 | TTCGGAGGACATTGAA | 19 | 1214 |
| 904157 | 2505 | 2520 | 14596 | 14611 | AAGCCGCTGCCTGACT | 48 | 1215 |
| 904189 | 2591 | 2606 | 14682 | 14697 | TTCAGTGTTCAAGCAG | 92 | 1216 |
| 904253 | 2800 | 2815 | 14891 | 14906 | TCCTGGGCGGCGACAA | 92 | 1217 |
| 904317 | N/A | N/A | 1344 | 1359 | GGCACCATTCTGCAAC | 28 | 1218 |
| 904349 | N/A | N/A | 807 | 822 | CAACCCTCTATAGTTT | 12 | 1219 |
| 904381 | N/A | N/A | 2448 | 2463 | GGAGCCCTCCCTCCCG | 0 | 1220 |
| 904413 | N/A | N/A | 2821 | 2836 | TGTGTGATCCCCTAGG | 22 | 1221 |
| 904445 | N/A | N/A | 4206 | 4221 | GCCAGTGTTTTTACAA | 72 | 1222 |
| 904477 | N/A | N/A | 4691 | 4706 | TGAGCCACCAGTGGAC | 0 | 1223 |
| 904541 | N/A | N/A | 5110 | 5125 | CCCCCCGCTGATTCCA | 31 | 1224 |
| 904573 | N/A | N/A | 5238 | 5253 | AGCCTCAGGTGGAAAC | 53 | 1225 |
| 904605 | N/A | N/A | 5339 | 5354 | GGGTCCAGTTAAGCTG | 14 | 1226 |
| 904669 | N/A | N/A | 5658 | 5673 | TAGATGACTGAACTCA | 79 | 1227 |
| 904701 | N/A | N/A | 5761 | 5776 | GCCTCCTCCAGTTTGC | 34 | 1228 |
| 904733 | N/A | N/A | 5801 | 5816 | GATAAACCTTGTCTCC | 65 | 1229 |
| 904765 | N/A | N/A | 5856 | 5871 | GTTTTGTAAGTGCAAC | 73 | 1230 |

TABLE 18-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
| --- | --- | --- | --- | --- | --- | --- | --- |
| 904797 | N/A | N/A | 5928 | 5943 | GGAGACCTCCCTAAAC | 33 | 1231 |
| 904829 | N/A | N/A | 5960 | 5975 | GGCAAGGCTAAGTTCC | 91 | 1232 |
| 904861 | N/A | N/A | 6111 | 6126 | CAGCAAAGACAAGAAC | 53 | 1233 |
| 904893 | N/A | N/A | 6201 | 6216 | GTACAAAACTGCATTG | 31 | 1234 |
| 904925 | N/A | N/A | 6255 | 6270 | CACTAAACCCCACACC | 26 | 1235 |
| 904957 | N/A | N/A | 6323 | 6338 | GTGAGATCCAACTCGG | 77 | 1236 |
| 904989 | N/A | N/A | 6374 | 6389 | TGGGCCCACAGGATCC | 4 | 1237 |
| 905021 | N/A | N/A | 6537 | 6552 | ACTTCTGTTAGATACA | 95 | 1238 |
| 905053 | N/A | N/A | 6594 | 6609 | GTAACCCCTGAAACT | 45 | 1239 |
| 905085 | N/A | N/A | 6638 | 6653 | AACATTCCTGGACAGG | 31 | 1240 |
| 905117 | N/A | N/A | 6742 | 6757 | CCCAGGTTTGGATGGA | 49 | 1241 |
| 905149 | N/A | N/A | 6828 | 6843 | AGGGAAATGAACGCAA | 86 | 1242 |
| 905181 | N/A | N/A | 6988 | 7003 | GCTGAGTGCTCTCGGC | 57 | 1243 |
| 905213 | N/A | N/A | 7118 | 7133 | GGGTACACGGCTCTCC | 38 | 1244 |
| 905245 | N/A | N/A | 7239 | 7254 | GTCTTGGGCACTCTCA | 89 | 1245 |
| 905277 | N/A | N/A | 7300 | 7315 | TAATGTCTCAAACTCC | 90 | 1246 |
| 905309 | N/A | N/A | 7469 | 7484 | ACCGCCCAAAACCATC | 57 | 1247 |
| 905341 | N/A | N/A | 7836 | 7851 | TGCACACACAAGAGAC | 0 | 1248 |
| 905373 | N/A | N/A | 7922 | 7937 | GGAATTATGGAATTGC | 98 | 1249 |
| 905405 | N/A | N/A | 7995 | 8010 | AACTCAAGTCAGTACA | 81 | 1250 |
| 905437 | N/A | N/A | 8081 | 8096 | CCCTGTAATCACACCC | 71 | 1251 |
| 905501 | N/A | N/A | 8311 | 8326 | TATTGGTTCAAAAGCA | 87 | 1252 |
| 905533 | N/A | N/A | 8381 | 8396 | CTGTTGGGTCAAACAC | 41 | 1253 |
| 905565 | N/A | N/A | 8450 | 8465 | AACATGAAGTGAGCCT | 88 | 1254 |
| 905597 | N/A | N/A | 8621 | 8636 | TTTTGGCACCTTCACC | 76 | 1255 |
| 905629 | N/A | N/A | 8739 | 8754 | ATTAGAGGGCTAGTGT | 73 | 1256 |
| 905661 | N/A | N/A | 8824 | 8839 | AAACTCAGGTGACTAC | 75 | 1257 |
| 905693 | N/A | N/A | 8884 | 8899 | TGGAGTCATTAGTGCT | 91 | 1258 |
| 905725 | N/A | N/A | 8953 | 8968 | AACAGCCATTGCATAA | 10 | 1259 |

TABLE 19

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 74 | 13 |
| 903426 | 24 | 39 | 517 | 532 | CAAGATATACCGAGGA | 0 | 1260 |
| 903458 | 125 | 140 | 618 | 633 | TTCCCCTGGCAGAGAC | 3 | 1261 |
| 903490 | 253 | 268 | N/A | N/A | CCCTCGCTCCAGCTTC | 61 | 1262 |
| 903522 | 303 | 318 | 4778 | 4793 | CTTACTTTGAGGATCT | 68 | 1263 |
| 903618 | 560 | 575 | 12651 | 12666 | TACTGCTGGCCTTTAT | 59 | 1264 |
| 903650 | 629 | 644 | 12720 | 12735 | CGGAGCCTTCTTATGT | 30 | 1265 |
| 903682 | 670 | 685 | 12761 | 12776 | TGGTGCCTTTGTGGAC | 0 | 1266 |
| 903714 | 741 | 756 | 12832 | 12847 | CAGACCCATGCCGACG | 37 | 1267 |
| 903746 | 811 | 826 | 12902 | 12917 | AAGCGGCTGTGATTCC | 60 | 1268 |
| 903778 | 850 | 865 | 12941 | 12956 | TCTTTCCGTAGTCCAT | 14 | 1269 |
| 903810 | 931 | 946 | 13022 | 13037 | CACCCAAAAACTCCCT | 59 | 1270 |
| 903842 | 1008 | 1023 | 13099 | 13114 | GGCACGGATGTCCTTC | 48 | 1271 |
| 903874 | 1084 | 1099 | 13175 | 13190 | AGATTGGCTCAGTGAC | 91 | 1272 |
| 903906 | 1127 | 1142 | 13218 | 13233 | CTGGGTTCATTAACCC | 0 | 1273 |
| 903938 | 1212 | 1227 | 13303 | 13318 | CACGAGGTAGACTACA | 56 | 1274 |
| 903970 | 1345 | 1360 | 13436 | 13451 | GTTCTTGGTCCGCCTG | 62 | 1275 |
| 904002 | 1741 | 1756 | 13832 | 13847 | ACCCTCTTTATCCCCC | 91 | 1276 |
| 904034 | 1799 | 1814 | 13890 | 13905 | TGTGCTCAGCTATGGA | 84 | 1277 |
| 904066 | 1926 | 1941 | 14017 | 14032 | TTAGTCTAAAGTAAAC | 44 | 1278 |
| 904098 | 2284 | 2299 | 14375 | 14390 | TGCTGGTTCCTTCAAG | 76 | 1279 |
| 904130 | 2413 | 2428 | 14504 | 14519 | TCATTCTTCGGAGGAC | 73 | 1280 |
| 904162 | 2511 | 2526 | 14602 | 14617 | ATCAGGAAGCCGCTGC | 52 | 1281 |
| 904194 | 2609 | 2624 | 14700 | 14715 | ATGGCCCACCACCTGC | 0 | 1282 |
| 904226 | 2736 | 2751 | 14827 | 14842 | GCTAATTTTCTGACTG | 96 | 1283 |
| 904258 | 2805 | 2820 | 14896 | 14911 | GTCAATCCTGGGCGGC | 63 | 1284 |
| 904322 | N/A | N/A | 1374 | 1389 | TCATGATTGCAAAGCT | 20 | 1285 |
| 904354 | N/A | N/A | 837 | 852 | AGCTTTGTGAACCCAT | 10 | 1286 |
| 904386 | N/A | N/A | 2482 | 2497 | GCCCAAGCCCAGTCCA | 0 | 1287 |
| 904418 | N/A | N/A | 3410 | 3425 | AGGGTATATGAAAGTT | 77 | 1288 |
| 904450 | N/A | N/A | 4340 | 4355 | AGCCAGTGTGTATTGC | 83 | 1289 |
| 904482 | N/A | N/A | 4733 | 4748 | TTGCACCCTTGAGGAG | 0 | 1290 |
| 904514 | N/A | N/A | 5058 | 5073 | GCTAGGTGCCAGGGTA | 78 | 1291 |
| 904546 | N/A | N/A | 5115 | 5130 | CCCCCCCCCCCGCTGA | 16 | 1292 |
| 904578 | N/A | N/A | 5303 | 5318 | ACATTCCCACAGGGCC | 0 | 1293 |
| 904610 | N/A | N/A | 5361 | 5376 | GGATGTGGCAAAGGAC | 54 | 1294 |
| 904642 | N/A | N/A | 5490 | 5505 | GCCCTATTGTGTGGCA | 0 | 1295 |

TABLE 19-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904674 | N/A | N/A | 5682 | 5697 | ATTTTTCTTTGACCGG | 64 | 1296 |
| 904706 | N/A | N/A | 5766 | 5781 | ACGAAGCCTCCTCCAG | 55 | 1297 |
| 904738 | N/A | N/A | 5807 | 5822 | TCACCCGATAAACCTT | 82 | 1298 |
| 904770 | N/A | N/A | 5868 | 5883 | CCCAAACAGGCAGTTT | 57 | 1299 |
| 904802 | N/A | N/A | 5933 | 5948 | TATTCGGAGACCTCCC | 5 | 1300 |
| 904834 | N/A | N/A | 5965 | 5980 | ACCTGGGCAAGGCTAA | 52 | 1301 |
| 904866 | N/A | N/A | 6138 | 6153 | CTTACTCCACACCTTA | 72 | 1302 |
| 904898 | N/A | N/A | 6206 | 6221 | GTTTGGTACAAAACTG | 0 | 1303 |
| 904930 | N/A | N/A | 6261 | 6276 | TTGTCTCACTAAACCC | 21 | 1304 |
| 904962 | N/A | N/A | 6330 | 6345 | AAGACCAGTGAGATCC | 50 | 1305 |
| 904994 | N/A | N/A | 6402 | 6417 | AACCACCTGTAGGGAC | 69 | 1306 |
| 905026 | N/A | N/A | 6542 | 6557 | TGGGTACTTCTGTTAG | 62 | 1307 |
| 905058 | N/A | N/A | 6600 | 6615 | ACAGCTGTAACCCCCT | 13 | 1308 |
| 905090 | N/A | N/A | 6680 | 6695 | TGGTGGATATAAAAGC | 39 | 1309 |
| 905122 | N/A | N/A | 6794 | 6809 | AGCGATTGTCTTGTTT | 72 | 1310 |
| 905154 | N/A | N/A | 6879 | 6894 | TGCCGTGGCAACTCTG | 6 | 1311 |
| 905186 | N/A | N/A | 7037 | 7052 | GTTTTTCCTCAGTCCC | 69 | 1312 |
| 905218 | N/A | N/A | 7159 | 7174 | GGCACCTCCATGTTGC | 0 | 1313 |
| 905250 | N/A | N/A | 7244 | 7259 | TGCTGGTCTTGGGCAC | 17 | 1314 |
| 905282 | N/A | N/A | 7339 | 7354 | CCTTATAGCTTACCTG | 64 | 1315 |
| 905314 | N/A | N/A | 7475 | 7490 | AGAGTCACCGCCCAAA | 58 | 1316 |
| 905346 | N/A | N/A | 7843 | 7858 | CTTGCCGTGCACACAC | 10 | 1317 |
| 905378 | N/A | N/A | 7939 | 7954 | TGGTTTGCAGGGATCT | 56 | 1318 |
| 905410 | N/A | N/A | 8001 | 8016 | ACAAAGAACTCAAGTC | 55 | 1319 |
| 905442 | N/A | N/A | 8088 | 8103 | GACTGCTCCCTGTAAT | 0 | 1320 |
| 905474 | N/A | N/A | 8175 | 8190 | ATGTGTTTAGGCATTC | 81 | 1321 |
| 905506 | N/A | N/A | 8327 | 8342 | CATTGGGTTATGAAAT | 48 | 1322 |
| 905538 | N/A | N/A | 8386 | 8401 | CATGCCTGTTGGGTCA | 46 | 1323 |
| 905570 | N/A | N/A | 8460 | 8475 | GCTCAGCACCAACATG | 0 | 1324 |
| 905602 | N/A | N/A | 8631 | 8646 | ACTCCAACCCTTTTGG | 10 | 1325 |
| 905634 | N/A | N/A | 8744 | 8759 | ATTCTATTAGAGGGCT | 85 | 1326 |
| 905666 | N/A | N/A | 8831 | 8846 | AAGCTTTAAACTCAGG | 62 | 1327 |
| 905698 | N/A | N/A | 8893 | 8908 | CTTGTTTTATGGAGTC | 97 | 1328 |
| 905730 | N/A | N/A | 8960 | 8975 | AGTGCATAACAGCCAT | 9 | 1329 |

TABLE 20

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 74 | 13 |
| 903427 | 25 | 40 | 518 | 533 | CCAAGATATACCGAGG | 12 | 1330 |
| 903459 | 129 | 144 | 622 | 637 | AATCTTCCCCTGGCAG | 13 | 1331 |
| 903491 | 254 | 269 | N/A | N/A | ACCCTCGCTCCAGCTT | 50 | 1332 |
| 903523 | 306 | 321 | 4781 | 4796 | GGGCTTACTTTGAGGA | 0 | 1333 |
| 903619 | 561 | 576 | 12652 | 12667 | GTACTGCTGGCCTTTA | 47 | 1334 |
| 903651 | 630 | 645 | 12721 | 12736 | ACGGAGCCTTCTTATG | 34 | 1335 |
| 903683 | 671 | 686 | 12762 | 12777 | GTGGTGCCTTTGTGGA | 0 | 1336 |
| 903715 | 742 | 757 | 12833 | 12848 | CCAGACCCATGCCGAC | 49 | 1337 |
| 903747 | 812 | 827 | 12903 | 12918 | AAAGCGGCTGTGATTC | 29 | 1338 |
| 903779 | 851 | 866 | 12942 | 12957 | TTCTTTCCGTAGTCCA | 38 | 1339 |
| 903811 | 932 | 947 | 13023 | 13038 | TCACCCAAAAACTCCC | 72 | 1340 |
| 903843 | 1010 | 1025 | 13101 | 13116 | AGGGCACGGATGTCCT | 3 | 1341 |
| 903875 | 1085 | 1100 | 13176 | 13191 | GAGATTGGCTCAGTGA | 69 | 1342 |
| 903907 | 1128 | 1143 | 13219 | 13234 | GCTGGGTTCATTAACC | 6 | 1343 |
| 903939 | 1230 | 1245 | 13321 | 13336 | TAAGTGCTTTGATTCG | 89 | 1344 |
| 903971 | 1346 | 1361 | 13437 | 13452 | AGTTCTTGGTCCGCCT | 52 | 1345 |
| 904003 | 1742 | 1757 | 13833 | 13848 | CACCCTCTTTATCCCC | 85 | 1346 |
| 904035 | 1800 | 1815 | 13891 | 13906 | CTGTGCTCAGCTATGG | 73 | 1347 |
| 904067 | 1928 | 1943 | 14019 | 14034 | CTTTAGTCTAAAGTAA | 16 | 1348 |
| 904099 | 2334 | 2349 | 14425 | 14440 | ACTCTTGGGCTTTCTC | 91 | 1349 |
| 904131 | 2414 | 2429 | 14505 | 14520 | TTCATTCTTCGGAGGA | 63 | 1350 |
| 904163 | 2512 | 2527 | 14603 | 14618 | CATCAGGAAGCCGCTG | 23 | 1351 |
| 904195 | 2612 | 2627 | 14703 | 14718 | GCCATGGCCCACCACC | 0 | 1352 |
| 904227 | 2744 | 2759 | 14835 | 14850 | GCTTTCATGCTAATTT | 40 | 1353 |
| 904259 | 2806 | 2821 | 14897 | 14912 | GGTCAATCCTGGGCGG | 58 | 1354 |
| 904323 | N/A | N/A | 1375 | 1390 | CTCATGATTGCAAAGC | 69 | 1355 |
| 904355 | N/A | N/A | 869 | 884 | CTCAGCAGTCAAAACC | 24 | 1356 |
| 904387 | N/A | N/A | 2515 | 2530 | GTTCCTAGAAGAAGCC | 25 | 1357 |
| 904419 | N/A | N/A | 3411 | 3426 | GAGGGTATATGAAAGT | 59 | 1358 |
| 904451 | N/A | N/A | 4351 | 4366 | TAGCTGGTGATAGCCA | 27 | 1359 |
| 904483 | N/A | N/A | 4735 | 4750 | TGTTGCACCCTTGAGG | 23 | 1360 |
| 904515 | N/A | N/A | 5064 | 5079 | TCATTTGCTAGGTGCC | 84 | 1361 |
| 904547 | N/A | N/A | 5172 | 5187 | GGTCAACCTCCTCTCC | 3 | 1362 |
| 904579 | N/A | N/A | 5304 | 5319 | TACATTCCCACAGGGC | 23 | 1363 |
| 904611 | N/A | N/A | 5379 | 5394 | CGCCAGGTCACACAGA | 69 | 1364 |
| 904643 | N/A | N/A | 5491 | 5506 | GGCCCTATTGTGTGGC | 0 | 1365 |

TABLE 20-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904675 | N/A | N/A | 5683 | 5698 | GATTTTTCTTTGACCG | 95 | 1366 |
| 904707 | N/A | N/A | 5767 | 5782 | CACGAAGCCTCCTCCA | 38 | 1367 |
| 904739 | N/A | N/A | 5808 | 5823 | TTCACCCGATAAACCT | 69 | 1368 |
| 904771 | N/A | N/A | 5869 | 5884 | ACCCAAACAGGCAGTT | 2 | 1369 |
| 904803 | N/A | N/A | 5934 | 5949 | GTATTCGGAGACCTCC | 25 | 1370 |
| 904835 | N/A | N/A | 5966 | 5981 | AACCTGGGCAAGGCTA | 21 | 1371 |
| 904867 | N/A | N/A | 6140 | 6155 | TGCTTACTCCACACCT | 65 | 1372 |
| 904899 | N/A | N/A | 6210 | 6225 | CCATGTTTGGTACAAA | 61 | 1373 |
| 904931 | N/A | N/A | 6262 | 6277 | CTTGTCTCACTAAACC | 30 | 1374 |
| 904963 | N/A | N/A | 6331 | 6346 | TAAGACCAGTGAGATC | 41 | 1375 |
| 904995 | N/A | N/A | 6403 | 6418 | AAACCACCTGTAGGGA | 42 | 1376 |
| 905027 | N/A | N/A | 6543 | 6558 | ATGGGTACTTCTGTTA | 79 | 1377 |
| 905059 | N/A | N/A | 6604 | 6619 | TAGAACAGCTGTAACC | 48 | 1378 |
| 905091 | N/A | N/A | 6682 | 6697 | GCTGGTGGATATAAAA | 0 | 1379 |
| 905123 | N/A | N/A | 6795 | 6810 | GAGCGATTGTCTTGTT | 89 | 1380 |
| 905155 | N/A | N/A | 6880 | 6895 | TTGCCGTGGCAACTCT | 0 | 1381 |
| 905187 | N/A | N/A | 7038 | 7053 | AGTTTTTCCTCAGTCC | 56 | 1382 |
| 905219 | N/A | N/A | 7160 | 7175 | AGGCACCTCCATGTTG | 11 | 1383 |
| 905251 | N/A | N/A | 7256 | 7271 | GGAGATTCCTCCTGCT | 0 | 1384 |
| 905283 | N/A | N/A | 7340 | 7355 | CCCTTATAGCTTACCT | 64 | 1385 |
| 905315 | N/A | N/A | 7476 | 7491 | GAGAGTCACCGCCCAA | 65 | 1386 |
| 905347 | N/A | N/A | 7844 | 7859 | TCTTGCCGTGCACACA | 26 | 1387 |
| 905379 | N/A | N/A | 7940 | 7955 | GTGGTTTGCAGGGATC | 82 | 1388 |
| 905411 | N/A | N/A | 8006 | 8021 | GGTCTACAAAGAACTC | 42 | 1389 |
| 905443 | N/A | N/A | 8089 | 8104 | GGACTGCTCCCTGTAA | 17 | 1390 |
| 905475 | N/A | N/A | 8176 | 8191 | GATGTGTTTAGGCATT | 84 | 1391 |
| 905507 | N/A | N/A | 8329 | 8344 | ATCATTGGGTTATGAA | 15 | 1392 |
| 905539 | N/A | N/A | 8387 | 8402 | ACATGCCTGTTGGGTC | 48 | 1393 |
| 905571 | N/A | N/A | 8461 | 8476 | AGCTCAGCACCAACAT | 22 | 1394 |
| 905603 | N/A | N/A | 8632 | 8647 | GACTCCAACCCTTTTG | 19 | 1395 |
| 905635 | N/A | N/A | 8745 | 8760 | AATTCTATTAGAGGGC | 80 | 1396 |
| 905667 | N/A | N/A | 8832 | 8847 | GAAGCTTTAAACTCAG | 83 | 1397 |
| 905699 | N/A | N/A | 8894 | 8909 | ACTTGTTTTATGGAGT | 30 | 1398 |
| 905731 | N/A | N/A | 8961 | 8976 | GAGTGCATAACAGCCA | 9 | 1399 |

TABLE 21

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 84 | 13 |
| 903436 | 41 | 56 | 534 | 549 | ACAGGTCCTCCAGTCC | 37 | 1400 |
| 903468 | 154 | 169 | 2364 | 2379 | TGTCGCTGCAGGGCCT | 35 | 1401 |
| 903500 | 263 | 278 | 12661 | 12676 | TTTTGTTGCACCCTCG | 84 | 1402 |
| 903532 | 346 | 361 | N/A | N/A | TGCTCTCTGGGTCCAT | 8 | 1403 |
| 903628 | 570 | 585 | N/A | N/A | CCAGTTTCTGTACTGC | 23 | 1404 |
| 903660 | 642 | 657 | 12733 | 12748 | ATCTGCAAGGGCACGG | 39 | 1405 |
| 903692 | 680 | 695 | 12771 | 12786 | TTGGCGATGGTGGTGC | 0 | 1406 |
| 903724 | 758 | 773 | 12849 | 12864 | CCCTCTGTGAAGGGTG | 0 | 1407 |
| 903756 | 824 | 839 | 12915 | 12930 | GTAATCCCGGTCAAAG | 41 | 1408 |
| 903788 | 862 | 877 | 12953 | 12968 | GTGTCCACCACTTCTT | 18 | 1409 |
| 903820 | 968 | 983 | 13059 | 13074 | GTATTGCCAGCTAAGG | 94 | 1410 |
| 903852 | 1032 | 1047 | 13123 | 13138 | AAGATTGGCTCTGGCT | 74 | 1411 |
| 903884 | 1097 | 1112 | 13188 | 13203 | CCGCTTTCAGCTGAGA | 39 | 1412 |
| 903916 | 1158 | 1173 | 13249 | 13264 | GAGCTTGACTCCTCTG | 5 | 1413 |
| 903948 | 1241 | 1256 | 13332 | 13347 | GCCCCCTCATGTAAGT | 11 | 1414 |
| 903980 | 1382 | 1397 | 13473 | 13488 | ATATCTCTCCTGGTGG | 69 | 1415 |
| 904012 | 1755 | 1770 | 13846 | 13861 | ATAAACTTTACCTCAC | 62 | 1416 |
| 904044 | 1842 | 1857 | 13933 | 13948 | CTTCTCCTTGCTGCAC | 84 | 1417 |
| 904076 | 1949 | 1964 | 14040 | 14055 | CACCCGGCCCCCCAAT | 36 | 1418 |
| 904108 | 2348 | 2363 | 14439 | 14454 | ATCCAACTGTTCTAAC | 64 | 1419 |
| 904140 | 2486 | 2501 | 14577 | 14592 | ATATGCCCCCAGGAGG | 40 | 1420 |
| 904172 | 2527 | 2542 | 14618 | 14633 | CACCCCAATGACCATC | 63 | 1421 |
| 904204 | 2679 | 2694 | 14770 | 14785 | TGGTTCTCACATACTC | 91 | 1422 |
| 904236 | 2777 | 2792 | 14868 | 14883 | CTAGAGATCTGAGCTT | 14 | 1423 |
| 904268 | 2846 | 2861 | 14937 | 14952 | CAGCTTGATGAGTAGG | 21 | 1424 |
| 904300 | N/A | N/A | 2354 | 2369 | GGGCCTCCTCCTTGAG | 2 | 1425 |
| 904364 | N/A | N/A | 1115 | 1130 | AAGTTGGTGCTCAGAC | 8 | 1426 |
| 904396 | N/A | N/A | 2572 | 2587 | ACAGCGGGTCCTCCCT | 60 | 1427 |
| 904428 | N/A | N/A | 3809 | 3824 | TCGCATAAAACTTTGC | 43 | 1428 |
| 904460 | N/A | N/A | 4464 | 4479 | CAGAGGACGGGCAGCC | 0 | 1429 |
| 904492 | N/A | N/A | 4914 | 4929 | AGTCCATCCGGGTTCT | 27 | 1430 |
| 904524 | N/A | N/A | 5074 | 5089 | CCCACTTGAGTCATTT | 67 | 1431 |
| 904556 | N/A | N/A | 5201 | 5216 | AGAGCGGGAGGTGACA | 25 | 1432 |
| 904588 | N/A | N/A | 5314 | 5329 | TCAGGCCCGATACATT | 0 | 1433 |
| 904620 | N/A | N/A | 5415 | 5430 | ATTATTCTCATGGTAC | 73 | 1434 |
| 904652 | N/A | N/A | 5500 | 5515 | CCTTAGGGAGGCCCTA | 16 | 1435 |

TABLE 21-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904684 | N/A | N/A | 5702 | 5717 | AAAATTCTATTGGGCC | 0 | 1436 |
| 904716 | N/A | N/A | 5779 | 5794 | TTTTCACCATAGCACG | 87 | 1437 |
| 904748 | N/A | N/A | 5828 | 5843 | GTCCTTACTGCAGTTT | 95 | 1438 |
| 904780 | N/A | N/A | 5891 | 5906 | CAGGGATTTTCCAACA | 77 | 1439 |
| 904812 | N/A | N/A | 5943 | 5958 | GTCTCACCTGTATTCG | 34 | 1440 |
| 904844 | N/A | N/A | 6022 | 6037 | TTGCACTAAAAGCTGA | 62 | 1441 |
| 904876 | N/A | N/A | 6153 | 6168 | CCAGAAATCCTTATGC | 35 | 1442 |
| 904908 | N/A | N/A | 6223 | 6238 | GTTCCATGTATGCCCA | 85 | 1443 |
| 904940 | N/A | N/A | 6280 | 6295 | ACACTCAATCATACCC | 64 | 1444 |
| 904972 | N/A | N/A | 6341 | 6356 | CCAATTCAGCTAAGAC | 73 | 1445 |
| 905004 | N/A | N/A | 6414 | 6429 | AGGAGTTGCTGAAACC | 69 | 1446 |
| 905036 | N/A | N/A | 6553 | 6568 | GTCATATCAGATGGGT | 92 | 1447 |
| 905068 | N/A | N/A | 6616 | 6631 | CTACGAGGCCTTTAGA | 23 | 1448 |
| 905100 | N/A | N/A | 6721 | 6736 | CCTCTGGCACTAAATC | 40 | 1449 |
| 905132 | N/A | N/A | 6804 | 6819 | TGGCTGGGCGAGCGAT | 38 | 1450 |
| 905164 | N/A | N/A | 6889 | 6904 | CTGACTTGGTTGCCGT | 60 | 1451 |
| 905196 | N/A | N/A | 7080 | 7095 | GGGCCTGTTATTAAAC | 0 | 1452 |
| 905228 | N/A | N/A | 7169 | 7184 | TGATCCTTGAGGCACC | 28 | 1453 |
| 905260 | N/A | N/A | 7270 | 7285 | AACTACCATGCAAAGG | 38 | 1454 |
| 905292 | N/A | N/A | 7380 | 7395 | ACTCCTTATGTTTTGA | 94 | 1455 |
| 905324 | N/A | N/A | 7485 | 7500 | CCAGACAGCGAGAGTC | 78 | 1456 |
| 905356 | N/A | N/A | 7862 | 7877 | GCATGATGTAAAATTG | 6 | 1457 |
| 905388 | N/A | N/A | 7975 | 7990 | AGGATTACTCCTGAAG | 0 | 1458 |
| 905420 | N/A | N/A | 8017 | 8032 | AAATAATGGTAGGTCT | 77 | 1459 |
| 905452 | N/A | N/A | 8120 | 8135 | GGTATATTCCTGACCA | 25 | 1460 |
| 905484 | N/A | N/A | 8185 | 8200 | TGGAATCCAGATGTGT | 65 | 1461 |
| 905516 | N/A | N/A | 8340 | 8355 | AATATCAACACATCAT | 82 | 1462 |
| 905548 | N/A | N/A | 8409 | 8424 | CCAGTGATCACTTCCA | 78 | 1463 |
| 905580 | N/A | N/A | 8517 | 8532 | AACATTGAAACACCAG | 94 | 1464 |
| 905612 | N/A | N/A | 8665 | 8680 | AGCTTCCATAAGCCAG | 12 | 1465 |
| 905644 | N/A | N/A | 8756 | 8771 | GGTAGGGCTCTAATTC | 60 | 1466 |
| 905676 | N/A | N/A | 8867 | 8882 | TAGAGGGAATTGTGTG | 61 | 1467 |
| 905708 | N/A | N/A | 8907 | 8922 | GCTGTGATGTGGGACT | 89 | 1468 |
| 905740 | N/A | N/A | 8971 | 8986 | GAAAGTGTGGGAGTGC | 8 | 1469 |

TABLE 22

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 82 | 13 |
| 903437 | 42 | 57 | 535 | 550 | GACAGGTCCTCCAGTC | 14 | 1470 |
| 903469 | 155 | 170 | 2365 | 2380 | ATGTCGCTGCAGGGCC | 18 | 1471 |
| 903533 | 349 | 364 | N/A | N/A | TACTGCTCTCTGGGTC | 33 | 1472 |
| 903629 | 571 | 586 | 12662 | 12677 | ACCAGTTTCTGTACTG | 4 | 1473 |
| 903661 | 643 | 658 | 12734 | 12749 | CATCTGCAAGGGCACG | 43 | 1474 |
| 903693 | 681 | 696 | 12772 | 12787 | ATTGGCGATGGTGGTG | 27 | 1475 |
| 903725 | 759 | 774 | 12850 | 12865 | TCCCTCTGTGAAGGGT | 0 | 1476 |
| 903757 | 827 | 842 | 12918 | 12933 | CTGGTAATCCCGGTCA | 63 | 1477 |
| 903789 | 863 | 878 | 12954 | 12969 | TGTGTCCACCACTTCT | 39 | 1478 |
| 903821 | 969 | 984 | 13060 | 13075 | AGTATTGCCAGCTAAG | 98 | 1479 |
| 903853 | 1033 | 1048 | 13124 | 13139 | GAAGATTGGCTCTGGC | 91 | 1480 |
| 903885 | 1098 | 1113 | 13189 | 13204 | ACCGCTTTCAGCTGAG | 10 | 1481 |
| 903917 | 1159 | 1174 | 13250 | 13265 | TGAGCTTGACTCCTCT | 6 | 1482 |
| 903949 | 1242 | 1257 | 13333 | 13348 | TGCCCCTCATGTAAG | 46 | 1483 |
| 903981 | 1384 | 1399 | 13475 | 13490 | GCATATCTCTCCTGGT | 81 | 1484 |
| 904013 | 1764 | 1779 | 13855 | 13870 | CTCAGTTCCATAAACT | 87 | 1485 |
| 904045 | 1844 | 1859 | 13935 | 13950 | GCCTTCTCCTTGCTGC | 57 | 1486 |
| 904077 | 1950 | 1965 | 14041 | 14056 | ACACCCGGCCCCCAA | 49 | 1487 |
| 904109 | 2349 | 2364 | 14440 | 14455 | TATCCAACTGTTCTAA | 68 | 1488 |
| 904141 | 2487 | 2502 | 14578 | 14593 | GATATGCCCCCAGGAG | 84 | 1489 |
| 904173 | 2528 | 2543 | 14619 | 14634 | CCACCCCAATGACCAT | 67 | 1490 |
| 904205 | 2680 | 2695 | 14771 | 14786 | TTGGTTCTCACATACT | 84 | 1491 |
| 904237 | 2778 | 2793 | 14869 | 14884 | TCTAGAGATCTGAGCT | 20 | 1492 |
| 904269 | 2847 | 2862 | 14938 | 14953 | CCAGCTTGATGAGTAG | 30 | 1493 |
| 904365 | N/A | N/A | 1116 | 1131 | CAAGTTGGTGCTCAGA | 0 | 1494 |
| 904397 | N/A | N/A | 2583 | 2598 | TCAACTAGGATACAGC | 82 | 1495 |
| 904429 | N/A | N/A | 3817 | 3832 | ATCCTTCTTCGCATAA | 80 | 1496 |
| 904461 | N/A | N/A | 4467 | 4482 | AATCAGAGGACGGGCA | 5 | 1497 |
| 904493 | N/A | N/A | 4916 | 4931 | CTAGTCCATCCGGGTT | 49 | 1498 |
| 904525 | N/A | N/A | 5075 | 5090 | CCCCACTTGAGTCATT | 57 | 1499 |
| 904557 | N/A | N/A | 5202 | 5217 | CAGAGCGGGAGGTGAC | 24 | 1500 |
| 904589 | N/A | N/A | 5315 | 5330 | ATCAGGCCCGATACAT | 0 | 1501 |
| 904621 | N/A | N/A | 5436 | 5451 | CTCAAGACAACATGGG | 43 | 1502 |
| 904653 | N/A | N/A | 5501 | 5516 | CCCTTAGGGAGGCCCT | 13 | 1503 |
| 904685 | N/A | N/A | 5721 | 5736 | CTTACTCAATTAACTC | 77 | 1504 |
| 904717 | N/A | N/A | 5782 | 5797 | ACTTTTTCACCATAGC | 94 | 1505 |

TABLE 22-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhi- bition | SEQ ID NO |
|---|---|---|---|---|---|---|---|
| 904749 | N/A | N/A | 5829 | 5844 | TGTCCTTACTGCAGTT | 82 | 1506 |
| 904781 | N/A | N/A | 5892 | 5907 | CCAGGGATTTTCCAAC | 69 | 1507 |
| 904813 | N/A | N/A | 5944 | 5959 | GGTCTCACCTGTATTC | 32 | 1508 |
| 904845 | N/A | N/A | 6023 | 6038 | TTTGCACTAAAAGCTG | 67 | 1509 |
| 904877 | N/A | N/A | 6154 | 6169 | CCCAGAAATCCTTATG | 37 | 1510 |
| 904909 | N/A | N/A | 6224 | 6239 | CGTTCCATGTATGCCC | 93 | 1511 |
| 904941 | N/A | N/A | 6281 | 6296 | CACACTCAATCATACC | 22 | 1512 |
| 904973 | N/A | N/A | 6343 | 6358 | GGCCAATTCAGCTAAG | 7 | 1513 |
| 905069 | N/A | N/A | 6617 | 6632 | CCTACGAGGCCTTTAG | 59 | 1514 |
| 905101 | N/A | N/A | 6722 | 6737 | ACCTCTGGCACTAAAT | 59 | 1515 |
| 905133 | N/A | N/A | 6805 | 6820 | TTGGCTGGGCGAGCGA | 61 | 1516 |
| 905165 | N/A | N/A | 6890 | 6905 | GCTGACTTGGTTGCCG | 10 | 1517 |
| 905197 | N/A | N/A | 7081 | 7096 | TGGGCCTGTTATTAAA | 14 | 1518 |
| 905229 | N/A | N/A | 7170 | 7185 | CTGATCCTTGAGGCAC | 72 | 1519 |
| 905261 | N/A | N/A | 7271 | 7286 | CAACTACCATGCAAAG | 53 | 1520 |
| 905293 | N/A | N/A | 7381 | 7396 | AACTCCTTATGTTTTG | 89 | 1521 |
| 905325 | N/A | N/A | 7486 | 7501 | TCCAGACAGCGAGAGT | 83 | 1522 |
| 905357 | N/A | N/A | 7863 | 7878 | GGCATGATGTAAAATT | 33 | 1523 |
| 905389 | N/A | N/A | 7977 | 7992 | GCAGGATTACTCCTGA | 10 | 1524 |
| 905421 | N/A | N/A | 8053 | 8068 | ACAGTGAAACAAGCAA | 93 | 1525 |
| 905453 | N/A | N/A | 8121 | 8136 | TGGTATATTCCTGACC | 35 | 1526 |
| 905485 | N/A | N/A | 8201 | 8216 | CCTTAATGTAAATTCC | 90 | 1527 |
| 905517 | N/A | N/A | 8345 | 8360 | ATGTGAATATCAACAC | 74 | 1528 |
| 905549 | N/A | N/A | 8410 | 8425 | CCCAGTGATCACTTCC | 78 | 1529 |
| 905581 | N/A | N/A | 8518 | 8533 | GAACATTGAAACACCA | 93 | 1530 |
| 905613 | N/A | N/A | 8666 | 8681 | CAGCTTCCATAAGCCA | 30 | 1531 |
| 905645 | N/A | N/A | 8767 | 8782 | GAGATCACAAGGGTAG | 98 | 1532 |
| 905677 | N/A | N/A | 8868 | 8883 | ATAGAGGGAATTGTGT | 45 | 1533 |
| 905709 | N/A | N/A | 8908 | 8923 | AGCTGTGATGTGGGAC | 63 | 1534 |
| 905741 | N/A | N/A | 8978 | 8993 | GTTGGAGGAAAGTGTG | 19 | 1535 |
| 905773 | N/A | N/A | 9795 | 9810 | TCTGACATAAGCCCAG | 0 | 1536 |
| 905805 | N/A | N/A | 10425 | 10440 | AGAACCACCTATATAA | 60 | 1537 |

TABLE 23

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 88 | 13 |
| 903422 | 20 | 35 | 513 | 528 | ATATACCGAGGAATTC | 7 | 1538 |
| 903454 | 77 | 92 | 570 | 585 | ATCCCACCTCCAGTTA | 49 | 1539 |
| 903486 | 218 | 233 | 4511 | 4526 | CCAAGGAAAAGTGCAC | 47 | 1540 |
| 903518 | 297 | 312 | 4772 | 4787 | TTGAGGATCTCCAGTA | 55 | 1541 |
| 903614 | 543 | 558 | 12634 | 12649 | GTGCCAGTTTTTGTCT | 0 | 1542 |
| 903646 | 625 | 640 | 12716 | 12731 | GCCTTCTTATGTTATC | 30 | 1543 |
| 903678 | 665 | 680 | 12756 | 12771 | CCTTTGTGGACCTTCT | 71 | 1544 |
| 903710 | 737 | 752 | 12828 | 12843 | CCCATGCCGACGAGGG | 11 | 1545 |
| 903742 | 807 | 822 | 12898 | 12913 | GGCTGTGATTCCCAAC | 28 | 1546 |
| 903774 | 845 | 860 | 12936 | 12951 | CCGTAGTCCATGGTAC | 11 | 1547 |
| 903806 | 902 | 917 | 12993 | 13008 | TTGTCAAGGCTTTTGA | 69 | 1548 |
| 903838 | 1004 | 1019 | 13095 | 13110 | CGGATGTCCTTCCCAA | 23 | 1549 |
| 903870 | 1080 | 1095 | 13171 | 13186 | TGGCTCAGTGACCCGG | 31 | 1550 |
| 903902 | 1122 | 1137 | 13213 | 13228 | TTCATTAACCCTCTCC | 74 | 1551 |
| 903934 | 1208 | 1223 | 13299 | 13314 | AGGTAGACTACATCCA | 40 | 1552 |
| 903966 | 1341 | 1356 | 13432 | 13447 | TTGGTCCGCCTGCAGA | 64 | 1553 |
| 903998 | 1708 | 1723 | 13799 | 13814 | TTGGGTCAAAAGCGAT | 92 | 1554 |
| 904030 | 1794 | 1809 | 13885 | 13900 | TCAGCTATGGAAATGC | 93 | 1555 |
| 904062 | 1921 | 1936 | 14012 | 14027 | CTAAAGTAAACTGCTT | 63 | 1556 |
| 904094 | 2279 | 2294 | 14370 | 14385 | GTTCCTTCAAGCCTCC | 92 | 1557 |
| 904126 | 2408 | 2423 | 14499 | 14514 | CTTCGGAGGACATTGA | 70 | 1558 |
| 904158 | 2506 | 2521 | 14597 | 14612 | GAAGCCGCTGCCTGAC | 78 | 1559 |
| 904190 | 2594 | 2609 | 14685 | 14700 | CCCTTCAGTGTTCAAG | 89 | 1560 |
| 904222 | 2720 | 2735 | 14811 | 14826 | TTTACTTACCGGGTAA | 22 | 1561 |
| 904254 | 2801 | 2816 | 14892 | 14907 | ATCCTGGGCGGCGACA | 84 | 1562 |
| 904318 | N/A | N/A | 1345 | 1360 | AGGCACCATTCTGCAA | 29 | 1563 |
| 904350 | N/A | N/A | 820 | 835 | TGAGCTGTTTCCCCAA | 39 | 1564 |
| 904382 | N/A | N/A | 2474 | 2489 | CCAGTCCAATTGTGCA | 43 | 1565 |
| 904414 | N/A | N/A | 2828 | 2843 | TGTTCACTGTGTGATC | 74 | 1566 |
| 904446 | N/A | N/A | 4306 | 4321 | GCCTCTTACATGTGTC | 52 | 1567 |
| 904478 | N/A | N/A | 4693 | 4708 | TGTGAGCCACCAGTGG | 0 | 1568 |
| 904510 | N/A | N/A | 5024 | 5039 | GGGCCGTGTCACCCTA | 8 | 1569 |
| 904542 | N/A | N/A | 5111 | 5126 | CCCCCCCGCTGATTCC | 19 | 1570 |
| 904574 | N/A | N/A | 5241 | 5256 | ACCAGCCTCAGGTGGA | 12 | 1571 |
| 904606 | N/A | N/A | 5353 | 5368 | CAAAGGACAGACCGGG | 64 | 1572 |
| 904638 | N/A | N/A | 5464 | 5479 | AGGCCAGGTAGCCGTG | 9 | 1573 |

TABLE 23-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904670 | N/A | N/A | 5659 | 5674 | TTAGATGACTGAACTC | 75 | 1574 |
| 904702 | N/A | N/A | 5762 | 5777 | AGCCTCCTCCAGTTTG | 32 | 1575 |
| 904734 | N/A | N/A | 5802 | 5817 | CGATAAACCTTGTCTC | 44 | 1576 |
| 904766 | N/A | N/A | 5858 | 5873 | CAGTTTTGTAAGTGCA | 97 | 1577 |
| 904798 | N/A | N/A | 5929 | 5944 | CGGAGACCTCCCTAAA | 12 | 1578 |
| 904830 | N/A | N/A | 5961 | 5976 | GGGCAAGGCTAAGTTC | 56 | 1579 |
| 904862 | N/A | N/A | 6112 | 6127 | CCAGCAAAGACAAGAA | 87 | 1580 |
| 904894 | N/A | N/A | 6202 | 6217 | GGTACAAAACTGCATT | 78 | 1581 |
| 904926 | N/A | N/A | 6256 | 6271 | TCACTAAACCCCACAC | 0 | 1582 |
| 904958 | N/A | N/A | 6325 | 6340 | CAGTGAGATCCAACTC | 40 | 1583 |
| 904990 | N/A | N/A | 6375 | 6390 | ATGGGCCCACAGGATC | 0 | 1584 |
| 905022 | N/A | N/A | 6538 | 6553 | TACTTCTGTTAGATAC | 92 | 1585 |
| 905054 | N/A | N/A | 6595 | 6610 | TGTAACCCCCTGAAAC | 17 | 1586 |
| 905086 | N/A | N/A | 6641 | 6656 | TGAAACATTCCTGGAC | 85 | 1587 |
| 905118 | N/A | N/A | 6743 | 6758 | ACCCAGGTTTGGATGG | 33 | 1588 |
| 905150 | N/A | N/A | 6875 | 6890 | GTGGCAACTCTGTAAG | 10 | 1589 |
| 905182 | N/A | N/A | 6989 | 7004 | GGCTGAGTGCTCTCGG | 60 | 1590 |
| 905214 | N/A | N/A | 7119 | 7134 | AGGGTACACGGCTCTC | 45 | 1591 |
| 905246 | N/A | N/A | 7240 | 7255 | GGTCTTGGGCACTCTC | 79 | 1592 |
| 905278 | N/A | N/A | 7301 | 7316 | ATAATGTCTCAAACTC | 77 | 1593 |
| 905310 | N/A | N/A | 7470 | 7485 | CACCGCCCAAAACCAT | 25 | 1594 |
| 905342 | N/A | N/A | 7838 | 7853 | CGTGCACACACAAGAG | 0 | 1595 |
| 905374 | N/A | N/A | 7923 | 7938 | GGGAATTATGGAATTG | 83 | 1596 |
| 905406 | N/A | N/A | 7996 | 8011 | GAACTCAAGTCAGTAC | 73 | 1597 |
| 905438 | N/A | N/A | 8083 | 8098 | CTCCCTGTAATCACAC | 40 | 1598 |
| 905470 | N/A | N/A | 8168 | 8183 | TAGGCATTCAGAATTT | 71 | 1599 |
| 905502 | N/A | N/A | 8313 | 8328 | ATTATTGGTTCAAAAG | 35 | 1600 |
| 905534 | N/A | N/A | 8382 | 8397 | CCTGTTGGGTCAAACA | 45 | 1601 |
| 905566 | N/A | N/A | 8452 | 8467 | CCAACATGAAGTGAGC | 79 | 1602 |
| 905598 | N/A | N/A | 8622 | 8637 | CTTTTGGCACCTTCAC | 83 | 1603 |
| 905630 | N/A | N/A | 8740 | 8755 | TATTAGAGGGCTAGTG | 55 | 1604 |
| 905662 | N/A | N/A | 8825 | 8840 | TAAACTCAGGTGACTA | 60 | 1605 |
| 905694 | N/A | N/A | 8885 | 8900 | ATGGAGTCATTAGTGC | 85 | 1606 |
| 905726 | N/A | N/A | 8954 | 8969 | TAACAGCCATTGCATA | 6 | 1607 |

TABLE 24

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 87 | 13 |
| 903423 | 21 | 36 | 514 | 529 | GATATACCGAGGAATT | 17 | 1608 |
| 903455 | 78 | 93 | 571 | 586 | GATCCCACCTCCAGTT | 29 | 1609 |
| 903487 | 220 | 235 | 4513 | 4528 | CACCAAGGAAAAGTGC | 3 | 1610 |
| 903519 | 300 | 315 | 4775 | 4790 | ACTTTGAGGATCTCCA | 66 | 1611 |
| 903615 | 544 | 559 | 12635 | 12650 | CGTGCCAGTTTTTGTC | 0 | 1612 |
| 903647 | 626 | 641 | 12717 | 12732 | AGCCTTCTTATGTTAT | 44 | 1613 |
| 903679 | 666 | 681 | 12757 | 12772 | GCCTTTGTGGACCTTC | 77 | 1614 |
| 903711 | 738 | 753 | 12829 | 12844 | ACCCATGCCGACGAGG | 19 | 1615 |
| 903743 | 808 | 823 | 12899 | 12914 | CGGCTGTGATTCCCAA | 19 | 1616 |
| 903775 | 846 | 861 | 12937 | 12952 | TCCGTAGTCCATGGTA | 5 | 1617 |
| 903807 | 907 | 922 | 12998 | 13013 | TCAATTTGTCAAGGCT | 94 | 1618 |
| 903839 | 1005 | 1020 | 13096 | 13111 | ACGGATGTCCTTCCCA | 40 | 1619 |
| 903871 | 1081 | 1096 | 13172 | 13187 | TTGGCTCAGTGACCCG | 44 | 1620 |
| 903903 | 1124 | 1139 | 13215 | 13230 | GGTTCATTAACCCTCT | 39 | 1621 |
| 903935 | 1209 | 1224 | 13300 | 13315 | GAGGTAGACTACATCC | 29 | 1622 |
| 903967 | 1342 | 1357 | 13433 | 13448 | CTTGGTCCGCCTGCAG | 42 | 1623 |
| 903999 | 1709 | 1724 | 13800 | 13815 | TTTGGGTCAAAAGCGA | 89 | 1624 |
| 904031 | 1796 | 1811 | 13887 | 13902 | GCTCAGCTATGGAAAT | 77 | 1625 |
| 904063 | 1923 | 1938 | 14014 | 14029 | GTCTAAAGTAAACTGC | 88 | 1626 |
| 904095 | 2281 | 2296 | 14372 | 14387 | TGGTTCCTTCAAGCCT | 35 | 1627 |
| 904127 | 2409 | 2424 | 14500 | 14515 | TCTTCGGAGGACATTG | 64 | 1628 |
| 904159 | 2507 | 2522 | 14598 | 14613 | GGAAGCCGCTGCCTGA | 80 | 1629 |
| 904191 | 2595 | 2610 | 14686 | 14701 | GCCCTTCAGTGTTCAA | 47 | 1630 |
| 904223 | 2721 | 2736 | 14812 | 14827 | GTTTACTTACCGGGTA | 83 | 1631 |
| 904255 | 2802 | 2817 | 14893 | 14908 | AATCCTGGGCGGCGAC | 79 | 1632 |
| 904319 | N/A | N/A | 1347 | 1362 | ACAGGCACCATTCTGC | 38 | 1633 |
| 904351 | N/A | N/A | 825 | 840 | CCATCTGAGCTGTTTC | 30 | 1634 |
| 904383 | N/A | N/A | 2475 | 2490 | CCCAGTCCAATTGTGC | 34 | 1635 |
| 904415 | N/A | N/A | 2885 | 2900 | TTGCTGTAAGGGACAA | 53 | 1636 |
| 904447 | N/A | N/A | 4310 | 4325 | CAGAGCCTCTTACATG | 47 | 1637 |
| 904479 | N/A | N/A | 4694 | 4709 | ATGTGAGCCACCAGTG | 46 | 1638 |
| 904511 | N/A | N/A | 5025 | 5040 | TGGGCCGTGTCACCCT | 9 | 1639 |
| 904543 | N/A | N/A | 5112 | 5127 | CCCCCCCCGCTGATTC | 43 | 1640 |
| 904575 | N/A | N/A | 5243 | 5258 | GGACCAGCCTCAGGTG | 0 | 1641 |
| 904607 | N/A | N/A | 5354 | 5369 | GCAAAGGACAGACCGG | 32 | 1642 |
| 904639 | N/A | N/A | 5465 | 5480 | CAGGCCAGGTAGCCGT | 22 | 1643 |

TABLE 24-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 904671 | N/A | N/A | 5660 | 5675 | TTTAGATGACTGAACT | 69 | 1644 |
| 904703 | N/A | N/A | 5763 | 5778 | AAGCCTCCTCCAGTTT | 23 | 1645 |
| 904735 | N/A | N/A | 5803 | 5818 | CCGATAAACCTTGTCT | 67 | 1646 |
| 904767 | N/A | N/A | 5859 | 5874 | GCAGTTTTGTAAGTGC | 43 | 1647 |
| 904799 | N/A | N/A | 5930 | 5945 | TCGGAGACCTCCCTAA | 25 | 1648 |
| 904831 | N/A | N/A | 5962 | 5977 | TGGGCAAGGCTAAGTT | 49 | 1649 |
| 904863 | N/A | N/A | 6135 | 6150 | ACTCCACACCTTAATT | 36 | 1650 |
| 904895 | N/A | N/A | 6203 | 6218 | TGGTACAAAACTGCAT | 66 | 1651 |
| 904927 | N/A | N/A | 6257 | 6272 | CTCACTAAACCCCACA | 29 | 1652 |
| 904959 | N/A | N/A | 6326 | 6341 | CCAGTGAGATCCAACT | 70 | 1653 |
| 904991 | N/A | N/A | 6376 | 6391 | GATGGGCCCACAGGAT | 2 | 1654 |
| 905023 | N/A | N/A | 6539 | 6554 | GTACTTCTGTTAGATA | 66 | 1655 |
| 905055 | N/A | N/A | 6597 | 6612 | GCTGTAACCCCCTGAA | 85 | 1656 |
| 905087 | N/A | N/A | 6645 | 6660 | GCCCTGAAACATTCCT | 20 | 1657 |
| 905119 | N/A | N/A | 6744 | 6759 | AACCCAGGTTTGGATG | 40 | 1658 |
| 905151 | N/A | N/A | 6876 | 6891 | CGTGGCAACTCTGTAA | 41 | 1659 |
| 905183 | N/A | N/A | 6991 | 7006 | TCGGCTGAGTGCTCTC | 63 | 1660 |
| 905215 | N/A | N/A | 7120 | 7135 | CAGGGTACACGGCTCT | 40 | 1661 |
| 905247 | N/A | N/A | 7241 | 7256 | TGGTCTTGGGCACTCT | 76 | 1662 |
| 905279 | N/A | N/A | 7335 | 7350 | ATAGCTTACCTGTGGG | 38 | 1663 |
| 905311 | N/A | N/A | 7471 | 7486 | TCACCGCCCAAAACCA | 29 | 1664 |
| 905343 | N/A | N/A | 7839 | 7854 | CCGTGCACACACAAGA | 0 | 1665 |
| 905375 | N/A | N/A | 7928 | 7943 | GATCTGGGAATTATGG | 62 | 1666 |
| 905407 | N/A | N/A | 7997 | 8012 | AGAACTCAAGTCAGTA | 92 | 1667 |
| 905439 | N/A | N/A | 8084 | 8099 | GCTCCCTGTAATCACA | 35 | 1668 |
| 905471 | N/A | N/A | 8172 | 8187 | TGTTTAGGCATTCAGA | 86 | 1669 |
| 905503 | N/A | N/A | 8317 | 8332 | TGAAATTATTGGTTCA | 6 | 1670 |
| 905535 | N/A | N/A | 8383 | 8398 | GCCTGTTGGGTCAAAC | 60 | 1671 |
| 905567 | N/A | N/A | 8453 | 8468 | ACCAACATGAAGTGAG | 72 | 1672 |
| 905599 | N/A | N/A | 8623 | 8638 | CCTTTTGGCACCTTCA | 93 | 1673 |
| 905631 | N/A | N/A | 8741 | 8756 | CTATTAGAGGGCTAGT | 78 | 1674 |
| 905663 | N/A | N/A | 8827 | 8842 | TTTAAACTCAGGTGAC | 64 | 1675 |
| 905695 | N/A | N/A | 8886 | 8901 | TATGGAGTCATTAGTG | 81 | 1676 |
| 905727 | N/A | N/A | 8955 | 8970 | ATAACAGCCATTGCAT | 14 | 1677 |

TABLE 25

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 793406 | N/A | N/A | 8306 | 8321 | GTTCAAAAGCAGCATT | 95 | 13 |
| 903501 | 264 | 279 | N/A | N/A | GTTTTGTTGCACCCTC | 98 | 1678 |
| 903543 | 402 | 417 | 9065 | 9080 | ATTCTGTGTGCTCACT | 98 | 1679 |
| 903545 | 405 | 420 | 9068 | 9083 | CAGATTCTGTGTGCTC | 98 | 1680 |
| 903556 | 419 | 434 | 9082 | 9097 | GTCAGCAGGAGTAGCA | 65 | 1681 |
| 903557 | 421 | 436 | 9084 | 9099 | CAGTCAGCAGGAGTAG | 84 | 1682 |
| 903558 | 422 | 437 | 9085 | 9100 | TCAGTCAGCAGGAGTA | 92 | 1683 |
| 903564 | 429 | 444 | 9092 | 9107 | CTCATTATCAGTCAGC | 94 | 1684 |
| 903567 | 434 | 449 | 9097 | 9112 | CAGGCCTCATTATCAG | 40 | 1685 |
| 903568 | 435 | 450 | 9098 | 9113 | CCAGGCCTCATTATCA | 52 | 1686 |
| 903569 | 436 | 451 | 9099 | 9114 | TCCAGGCCTCATTATC | 69 | 1687 |
| 903570 | 437 | 452 | 9100 | 9115 | TTCCAGGCCTCATTAT | 55 | 1688 |
| 903571 | 438 | 453 | 9101 | 9116 | GTTCCAGGCCTCATTA | 74 | 1689 |
| 903572 | 439 | 454 | 9102 | 9117 | CGTTCCAGGCCTCATT | 97 | 1690 |
| 903573 | 440 | 455 | 9103 | 9118 | CCGTTCCAGGCCTCAT | 81 | 1691 |
| 903574 | 441 | 456 | 9104 | 9119 | TCCGTTCCAGGCCTCA | 85 | 1692 |
| 903575 | 443 | 458 | 9106 | 9121 | AATCCGTTCCAGGCCT | 52 | 1693 |
| 903576 | 444 | 459 | 9107 | 9122 | GAATCCGTTCCAGGCC | 55 | 1694 |
| 903577 | 445 | 460 | 9108 | 9123 | CGAATCCGTTCCAGGC | 45 | 1695 |
| 903578 | 446 | 461 | 9109 | 9124 | ACGAATCCGTTCCAGG | 43 | 1696 |
| 903579 | 447 | 462 | 9110 | 9125 | CACGAATCCGTTCCAG | 61 | 1697 |
| 903581 | 449 | 464 | 9112 | 9127 | GCCACGAATCCGTTCC | 35 | 1698 |
| 903582 | 450 | 465 | 9113 | 9128 | AGCCACGAATCCGTTC | 53 | 1699 |
| 903583 | 451 | 466 | 9114 | 9129 | CAGCCACGAATCCGTT | 47 | 1700 |
| 903584 | 452 | 467 | 9115 | 9130 | GCAGCCACGAATCCGT | 40 | 1701 |
| 903585 | 453 | 468 | 9116 | 9131 | AGCAGCCACGAATCCG | 82 | 1702 |
| 903586 | 469 | 484 | N/A | N/A | TCCTGGGCAGTTCAGC | 53 | 1703 |
| 903587 | 471 | 486 | N/A | N/A | ATTCCTGGGCAGTTCA | 89 | 1704 |
| 903589 | 473 | 488 | N/A | N/A | TCATTCCTGGGCAGTT | 74 | 1705 |
| 903592 | 501 | 516 | 12592 | 12607 | GTCCAGAGCTTTACGG | 65 | 1706 |
| 903595 | 504 | 519 | 12595 | 12610 | GTTGTCCAGAGCTTTA | 94 | 1707 |
| 903596 | 505 | 520 | 12596 | 12611 | GGTTGTCCAGAGCTTT | 98 | 1708 |
| 903597 | 506 | 521 | 12597 | 12612 | AGGTTGTCCAGAGCTT | 83 | 1709 |
| 903598 | 507 | 522 | 12598 | 12613 | AAGGTTGTCCAGAGCT | 80 | 1710 |
| 903599 | 508 | 523 | 12599 | 12614 | CAAGGTTGTCCAGAGC | 91 | 1711 |
| 903600 | 509 | 524 | 12600 | 12615 | GCAAGGTTGTCCAGAG | 90 | 1712 |
| 903606 | 515 | 530 | 12606 | 12621 | TGTCTTGCAAGGTTGT | 98 | 1713 |

TABLE 25-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 903607 | 516 | 531 | 12607 | 12622 | TTGTCTTGCAAGGTTG | 96 | 1714 |
| 903639 | 616 | 631 | 12707 | 12722 | TGTTATCCTCAAGCTC | 76 | 1715 |
| 903959 | 1334 | 1349 | 13425 | 13440 | GCCTGCAGAATCTTAT | 65 | 1716 |
| 903991 | 1394 | 1409 | 13485 | 13500 | CCCCTGCCAGGCATAT | 71 | 1717 |
| 903997 | 1707 | 1722 | 13798 | 13813 | TGGGTCAAAAGCGATG | 96 | 1718 |
| 904055 | 1867 | 1882 | 13958 | 13973 | TTATTGCAGGCTCCAA | 96 | 1719 |
| 904221 | 2719 | 2734 | 14810 | 14825 | TTACTTACCGGGTAAG | 57 | 1720 |
| 904279 | N/A | N/A | 449 | 464 | CAGCAAACACGCTCCC | 23 | 1721 |
| 904509 | N/A | N/A | 5023 | 5038 | GGCCGTGTCACCCTAA | 46 | 1722 |
| 904637 | N/A | N/A | 5463 | 5478 | GGCCAGGTAGCCGTGT | 46 | 1723 |
| 904951 | N/A | N/A | 6306 | 6321 | GCTGGGTCTGACCCAC | 0 | 1724 |
| 905005 | N/A | N/A | 6415 | 6430 | AAGGAGTTGCTGAAAC | 75 | 1725 |
| 905015 | N/A | N/A | 6438 | 6453 | GCAGGTTCACATGACA | 88 | 1726 |
| 905019 | N/A | N/A | 6534 | 6549 | TCTGTTAGATACAAAC | 92 | 1727 |
| 905037 | N/A | N/A | 6570 | 6585 | TGGGAAACTCAACTGG | 77 | 1728 |
| 905111 | N/A | N/A | 6734 | 6749 | TGGATGGAAGGAACCT | 73 | 1729 |
| 905469 | N/A | N/A | 8164 | 8179 | CATTCAGAATTTCCAC | 98 | 1730 |
| 905837 | N/A | N/A | 11345 | 11360 | CCCACCATTGATGGGT | 30 | 1731 |
| 905869 | N/A | N/A | 12150 | 12165 | TCACTATCGATCAAAT | 53 | 1732 |

TABLE 26

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 905758 | N/A | N/A | 9461 | 9476 | CACTTTACATGCACGA | 90 | 1733 |
| 905867 | N/A | N/A | 12079 | 12094 | TCATCATAGATACTCC | 87 | 1734 |
| 972204 | N/A | N/A | 9219 | 9234 | GGAGGTGTGCCTGTCA | 49 | 1735 |
| 972206 | N/A | N/A | 9311 | 9326 | GCTACTCACTGCCAGC | 0 | 1736 |
| 972208 | N/A | N/A | 9356 | 9371 | AGAAATGACCCTGTTC | 31 | 1737 |
| 972210 | N/A | N/A | 9450 | 9465 | CACGATCTCATTTTTC | 79 | 1738 |
| 972212 | N/A | N/A | 9453 | 9468 | ATGCACGATCTCATTT | 5 | 1739 |
| 972214 | N/A | N/A | 9455 | 9470 | ACATGCACGATCTCAT | 48 | 1740 |
| 972216 | N/A | N/A | 9458 | 9473 | TTTACATGCACGATCT | 66 | 1741 |
| 972218 | N/A | N/A | 9460 | 9475 | ACTTTACATGCACGAT | 89 | 1742 |
| 972220 | N/A | N/A | 9481 | 9496 | GTGTCAGTCATTATGC | 79 | 1743 |

TABLE 26-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 972222 | N/A | N/A | 9501 | 9516 | GTTAACTGTGCACCTA | 25 | 1744 |
| 972224 | N/A | N/A | 9519 | 9534 | AGCTTGTAAGATGTTA | 44 | 1745 |
| 972226 | N/A | N/A | 9551 | 9566 | GAAGATCCTTAACCCT | 46 | 1746 |
| 972228 | N/A | N/A | 9622 | 9637 | ACATTGGTTAGGTCAG | 82 | 1747 |
| 972230 | N/A | N/A | 9624 | 9639 | ACACATTGGTTAGGTC | 55 | 1748 |
| 972232 | N/A | N/A | 9672 | 9687 | GGAATTCCTCAGATGA | 15 | 1749 |
| 972234 | N/A | N/A | 9678 | 9693 | GTTTATGGAATTCCTC | 95 | 1750 |
| 972236 | N/A | N/A | 9689 | 9704 | GGTCCTGCCGTGTTTA | 29 | 1751 |
| 972238 | N/A | N/A | 9846 | 9861 | TCCTATCACATTGAGT | 37 | 1752 |
| 972240 | N/A | N/A | 9869 | 9884 | TGCCTCTAAGGCCTTC | 10 | 1753 |
| 972242 | N/A | N/A | 9904 | 9919 | ATCTTGGTGTTGGTTC | 68 | 1754 |
| 972244 | N/A | N/A | 10059 | 10074 | TTAAGTTTCAAGCCCT | 77 | 1755 |
| 972246 | N/A | N/A | 10072 | 10087 | GTTCATGACCTCCTTA | 76 | 1756 |
| 972248 | N/A | N/A | 10083 | 10098 | GTCCTCTGCAAGTTCA | 65 | 1757 |
| 972250 | N/A | N/A | 10125 | 10140 | GATCATCCAGACAGGG | 27 | 1758 |
| 972252 | N/A | N/A | 10196 | 10211 | GAACTTGCCAGTTCCA | 32 | 1759 |
| 972254 | N/A | N/A | 10257 | 10272 | TGCTTGTCAATGTCAG | 72 | 1760 |
| 972256 | N/A | N/A | 10265 | 10280 | AGACATACTGCTTGTC | 0 | 1761 |
| 972258 | N/A | N/A | 10285 | 10300 | TACTATGAAAATGGTC | 11 | 1762 |
| 972260 | N/A | N/A | 10297 | 10312 | AGCAACTAATTCTACT | 47 | 1763 |
| 972262 | N/A | N/A | 10307 | 10322 | ACAAATTGGCAGCAAC | 81 | 1764 |
| 972264 | N/A | N/A | 10309 | 10324 | ACACAAATTGGCAGCA | 72 | 1765 |
| 972266 | N/A | N/A | 10420 | 10435 | CACCTATATAAATTGC | 39 | 1766 |
| 972268 | N/A | N/A | 10464 | 10479 | GCAATTTTATGGAACC | 94 | 1767 |
| 972270 | N/A | N/A | 10507 | 10522 | CTTAGTAGTGACAGCT | 40 | 1768 |
| 972272 | N/A | N/A | 10521 | 10536 | AGCCTAACTGATGCCT | 14 | 1769 |
| 972274 | N/A | N/A | 10543 | 10558 | GGTCTCACTCGCAGGT | 52 | 1770 |
| 972276 | N/A | N/A | 10623 | 10638 | GGCTATTCATTCTGGC | 0 | 1771 |
| 972278 | N/A | N/A | 10631 | 10646 | GGAGATCTGGCTATTC | 71 | 1772 |
| 972280 | N/A | N/A | 10669 | 10684 | GCTACTGGTTCTGGCC | 0 | 1773 |
| 972282 | N/A | N/A | 10774 | 10789 | GAGTACTTTGAATTCA | 0 | 1774 |
| 972284 | N/A | N/A | 10788 | 10803 | GTCTGGCTATCTCTGA | 49 | 1775 |
| 972286 | N/A | N/A | 10798 | 10813 | AGACATTGCAGTCTGG | 22 | 1776 |
| 972288 | N/A | N/A | 10835 | 10850 | TAAATTTGCAGGTGGT | 96 | 1777 |
| 972290 | N/A | N/A | 10837 | 10852 | CTTAAATTTGCAGGTG | 89 | 1778 |
| 972292 | N/A | N/A | 10852 | 10867 | GGATTTAGAAATCCCC | 7 | 1779 |
| 972294 | N/A | N/A | 10944 | 10959 | TGTGTTCTTTCCGTGT | 48 | 1780 |

TABLE 26-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 972296 | N/A | N/A | 11017 | 11032 | GACAATGAAGCTTCAC | 60 | 1781 |
| 972298 | N/A | N/A | 11097 | 11112 | TTAACTGGGTGAGCTT | 27 | 1782 |
| 972300 | N/A | N/A | 11122 | 11137 | TAATGTGATTCACAGG | 98 | 1783 |
| 972302 | N/A | N/A | 11126 | 11141 | GGTTTAATGTGATTCA | 90 | 1784 |
| 972304 | N/A | N/A | 11148 | 11163 | CCTGAAAAAGGCTTC | 55 | 1785 |
| 972306 | N/A | N/A | 11160 | 11175 | TGTAACAACAATCCTG | 61 | 1786 |
| 972308 | N/A | N/A | 11196 | 11211 | TTACTATATTTGGAGC | 33 | 1787 |
| 972310 | N/A | N/A | 11264 | 11279 | TGTCTCCTATCAGTCC | 36 | 1788 |
| 972312 | N/A | N/A | 11291 | 11306 | CAATTTAGCAGGAACC | 36 | 1789 |
| 972314 | N/A | N/A | 11361 | 11376 | GATTATGCTCTTCACC | 59 | 1790 |
| 972316 | N/A | N/A | 11366 | 11381 | TATCTGATTATGCTCT | 78 | 1791 |
| 972318 | N/A | N/A | 11380 | 11395 | TGATTACGCTTTGCTA | 15 | 1792 |
| 972320 | N/A | N/A | 11382 | 11397 | TCTGATTACGCTTTGC | 79 | 1793 |
| 972322 | N/A | N/A | 11582 | 11597 | AGATACTCTGGACACT | 50 | 1794 |
| 972324 | N/A | N/A | 11606 | 11621 | GGCAGCTTGTGATCCA | 0 | 1795 |
| 972326 | N/A | N/A | 11731 | 11746 | CCGTATAGGAATCTGA | 37 | 1796 |
| 972328 | N/A | N/A | 11749 | 11764 | GGTGATTTGGCCACGG | 56 | 1797 |
| 972330 | N/A | N/A | 11804 | 11819 | AGTGATCTCCAGGCCC | 25 | 1798 |
| 972332 | N/A | N/A | 11956 | 11971 | GTGACTGCCAAAGTGT | 22 | 1799 |
| 972334 | N/A | N/A | 11996 | 12011 | TTGATAAAGATGCCTC | 76 | 1800 |
| 972336 | N/A | N/A | 12011 | 12026 | TTTCATGGTAGGTGTT | 76 | 1801 |
| 972338 | N/A | N/A | 12070 | 12085 | ATACTCCTCAATATTT | 41 | 1802 |
| 972340 | N/A | N/A | 12073 | 12088 | TAGATACTCCTCAATA | 56 | 1803 |
| 972342 | N/A | N/A | 12078 | 12093 | CATCATAGATACTCCT | 88 | 1804 |
| 972344 | N/A | N/A | 12081 | 12096 | GTTCATCATAGATACT | 26 | 1805 |
| 972346 | N/A | N/A | 12180 | 12195 | GATCTCTATCCTGTGT | 36 | 1806 |
| 972348 | N/A | N/A | 14951 | 14966 | GACTCGAACAAGTCCA | 1 | 1807 |
| 972350 | N/A | N/A | 15111 | 15126 | CTTCATCGGTCCATCG | 30 | 1808 |
| 972352 | N/A | N/A | 15298 | 15313 | TCCAGGTACCCTTCTA | 2 | 1809 |
| 972354 | N/A | N/A | 15311 | 15326 | AGACATCACCTTGTCC | 1 | 1810 |

TABLE 27

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 905758 | N/A | N/A | 9461 | 9476 | CACTTTACATGCACGA | 88 | 1733 |
| 905867 | N/A | N/A | 12079 | 12094 | TCATCATAGATACTCC | 85 | 1734 |
| 972205 | N/A | N/A | 9277 | 9292 | ATTCTTCCTGGAGTGC | 50 | 1811 |
| 972207 | N/A | N/A | 9315 | 9330 | TGAGGCTACTCACTGC | 0 | 1812 |
| 972209 | N/A | N/A | 9390 | 9405 | GTAACTGGCAAAGTTC | 3 | 1813 |
| 972211 | N/A | N/A | 9452 | 9467 | TGCACGATCTCATTTT | 29 | 1814 |
| 972213 | N/A | N/A | 9454 | 9469 | CATGCACGATCTCATT | 23 | 1815 |
| 972215 | N/A | N/A | 9456 | 9471 | TACATGCACGATCTCA | 83 | 1816 |
| 972217 | N/A | N/A | 9459 | 9474 | CTTTACATGCACGATC | 55 | 1817 |
| 972219 | N/A | N/A | 9462 | 9477 | GCACTTTACATGCACG | 63 | 1818 |
| 972221 | N/A | N/A | 9483 | 9498 | GTGTGTCAGTCATTAT | 94 | 1819 |
| 972223 | N/A | N/A | 9502 | 9517 | CGTTAACTGTGCACCT | 50 | 1820 |
| 972225 | N/A | N/A | 9546 | 9561 | TCCTTAACCCTGGTTC | 21 | 1821 |
| 972227 | N/A | N/A | 9558 | 9573 | TCAAGAAGAAGATCCT | 48 | 1822 |
| 972229 | N/A | N/A | 9623 | 9638 | CACATTGGTTAGGTCA | 82 | 1823 |
| 972231 | N/A | N/A | 9626 | 9641 | ACACACATTGGTTAGG | 75 | 1824 |
| 972233 | N/A | N/A | 9675 | 9690 | TATGGAATTCCTCAGA | 40 | 1825 |
| 972235 | N/A | N/A | 9681 | 9696 | CGTGTTTATGGAATTC | 71 | 1826 |
| 972237 | N/A | N/A | 9841 | 9856 | TCACATTGAGTTGCTA | 85 | 1827 |
| 972239 | N/A | N/A | 9868 | 9883 | GCCTCTAAGGCCTTCA | 7 | 1828 |
| 972241 | N/A | N/A | 9899 | 9914 | GGTGTTGGTTCCCCAC | 31 | 1829 |
| 972243 | N/A | N/A | 9937 | 9952 | GCTGATCCCGGTCTCT | 42 | 1830 |
| 972245 | N/A | N/A | 10062 | 10077 | TCCTTAAGTTTCAAGC | 31 | 1831 |
| 972247 | N/A | N/A | 10077 | 10092 | TGCAAGTTCATGACCT | 41 | 1832 |
| 972249 | N/A | N/A | 10107 | 10122 | GAAATATCCCTCTCCC | 23 | 1833 |
| 972251 | N/A | N/A | 10148 | 10163 | CCCTATATGCCCATGA | 75 | 1834 |
| 972253 | N/A | N/A | 10197 | 10212 | AGAACTTGCCAGTTCC | 0 | 1835 |
| 972255 | N/A | N/A | 10264 | 10279 | GACATACTGCTTGTCA | 0 | 1836 |
| 972257 | N/A | N/A | 10272 | 10287 | GTCACTAAGACATACT | 8 | 1837 |
| 972259 | N/A | N/A | 10296 | 10311 | GCAACTAATTCTACTA | 80 | 1838 |
| 972261 | N/A | N/A | 10306 | 10321 | CAAATTGGCAGCAACT | 61 | 1839 |
| 972263 | N/A | N/A | 10308 | 10323 | CACAAATTGGCAGCAA | 91 | 1840 |
| 972265 | N/A | N/A | 10419 | 10434 | ACCTATATAAATTGCT | 22 | 1841 |
| 972267 | N/A | N/A | 10461 | 10476 | ATTTTATGGAACCTCT | 72 | 1842 |
| 972269 | N/A | N/A | 10495 | 10510 | AGCTTCACCTGTGTGC | 10 | 1843 |
| 972271 | N/A | N/A | 10510 | 10525 | TGCCTTAGTAGTGACA | 34 | 1844 |
| 972273 | N/A | N/A | 10539 | 10554 | TCACTCGCAGGTGTCA | 30 | 1845 |

TABLE 27-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhi-bition | SEQ ID NO |
|---|---|---|---|---|---|---|---|
| 972275 | N/A | N/A | 10622 | 10637 | GCTATTCATTCTGGCT | 0 | 1846 |
| 972277 | N/A | N/A | 10624 | 10639 | TGGCTATTCATTCTGG | 22 | 1847 |
| 972279 | N/A | N/A | 10664 | 10679 | TGGTTCTGGCCACTGC | 37 | 1848 |
| 972281 | N/A | N/A | 10732 | 10747 | GGAGTTCACTTTGCCT | 0 | 1849 |
| 972283 | N/A | N/A | 10783 | 10798 | GCTATCTCTGAGTACT | 13 | 1850 |
| 972285 | N/A | N/A | 10797 | 10812 | GACATTGCAGTCTGGC | 46 | 1851 |
| 972287 | N/A | N/A | 10800 | 10815 | TCAGACATTGCAGTCT | 0 | 1852 |
| 972289 | N/A | N/A | 10836 | 10851 | TTAAATTTGCAGGTGG | 92 | 1853 |
| 972291 | N/A | N/A | 10839 | 10854 | CCCTTAAATTTGCAGG | 19 | 1854 |
| 972293 | N/A | N/A | 10853 | 10868 | TGGATTTAGAAATCCC | 13 | 1855 |
| 972295 | N/A | N/A | 11012 | 11027 | TGAAGCTTCACACTTA | 29 | 1856 |
| 972297 | N/A | N/A | 11019 | 11034 | AGGACAATGAAGCTTC | 50 | 1857 |
| 972299 | N/A | N/A | 11100 | 11115 | TCCTTAACTGGGTGAG | 25 | 1858 |
| 972301 | N/A | N/A | 11125 | 11140 | GTTTAATGTGATTCAC | 88 | 1859 |
| 972303 | N/A | N/A | 11127 | 11142 | TGGTTTAATGTGATTC | 90 | 1860 |
| 972305 | N/A | N/A | 11159 | 11174 | GTAACAACAATCCTGA | 69 | 1861 |
| 972307 | N/A | N/A | 11195 | 11210 | TACTATATTTGGAGCT | 40 | 1862 |
| 972309 | N/A | N/A | 11200 | 11215 | GTCTTTACTATATTTG | 77 | 1863 |
| 972311 | N/A | N/A | 11290 | 11305 | AATTTAGCAGGAACCC | 53 | 1864 |
| 972313 | N/A | N/A | 11307 | 11322 | GAGAATCCTGTTAGGC | 51 | 1865 |
| 972315 | N/A | N/A | 11362 | 11377 | TGATTATGCTCTTCAC | 36 | 1866 |
| 972317 | N/A | N/A | 11368 | 11383 | GCTATCTGATTATGCT | 18 | 1867 |
| 972319 | N/A | N/A | 11381 | 11396 | CTGATTACGCTTTGCT | 33 | 1868 |
| 972321 | N/A | N/A | 11572 | 11587 | GACACTAAGGCATGGG | 77 | 1869 |
| 972323 | N/A | N/A | 11584 | 11599 | GCAGATACTCTGGACA | 46 | 1870 |
| 972325 | N/A | N/A | 11699 | 11714 | GGGCTATTTGGTGTCT | 22 | 1871 |
| 972327 | N/A | N/A | 11747 | 11762 | TGATTTGGCCACGGGA | 58 | 1872 |
| 972329 | N/A | N/A | 11767 | 11782 | GAACATCTGTCTTTGC | 42 | 1873 |
| 972331 | N/A | N/A | 11856 | 11871 | AGCATGAACTTTACCC | 53 | 1874 |
| 972333 | N/A | N/A | 11968 | 11983 | CAGGTCAACACCGTGA | 0 | 1875 |
| 972335 | N/A | N/A | 11998 | 12013 | GTTTGATAAAGATGCC | 77 | 1876 |
| 972337 | N/A | N/A | 12069 | 12084 | TACTCCTCAATATTTA | 66 | 1877 |
| 972339 | N/A | N/A | 12071 | 12086 | GATACTCCTCAATATT | 37 | 1878 |
| 972341 | N/A | N/A | 12077 | 12092 | ATCATAGATACTCCTC | 93 | 1879 |
| 972343 | N/A | N/A | 12080 | 12095 | TTCATCATAGATACTC | 87 | 1880 |
| 972345 | N/A | N/A | 12168 | 12183 | GTGTAAATTGCAGAGC | 82 | 1881 |

TABLE 27-continued

Inhibition of APOL1 mRNA by 3-10-3 cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | % inhibition | SEQ ID NO |
|---|---|---|---|---|---|---|---|
| 972347 | N/A | N/A | 12199 | 12214 | TGTGAAATGAGCTCCA | 78 | 1882 |
| 972349 | N/A | N/A | 14953 | 14968 | ATGACTCGAACAAGTC | 38 | 1883 |
| 972351 | N/A | N/A | 15116 | 15131 | TGGAACTTCATCGGTC | 5 | 1884 |
| 972353 | N/A | N/A | 15310 | 15325 | GACATCACCTTGTCCA | 16 | 1885 |
| 972355 | N/A | N/A | 15432 | 15447 | GGAAGTCAGGCACCCA | 16 | 1886 |

TABLE 28

Gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | SEQ ID NO |
|---|---|---|---|---|---|---|---|
| 904628 | N/A | N/A | 5450 | 5465 | TGTTATATTTGATCCT | kkk-d10-kkk | 1887 |
| 905141 | N/A | N/A | 6820 | 6835 | GAACGCAATGCTGACT | kkk-d10-kkk | 1888 |
| 905269 | N/A | N/A | 7283 | 7298 | CAGCATTGAGTACAAC | kkk-d10-kkk | 1889 |
| 905521 | N/A | N/A | 8366 | 8381 | CTTTATACCAGTGTCT | kkk-d10-kkk | 1890 |
| 905582 | N/A | N/A | 8520 | 8535 | GAGAACATTGAAACAC | kkk-d10-kkk | 1891 |
| 905684 | N/A | N/A | 8875 | 8890 | TAGTGCTATAGAGGGA | kkk-d10-kkk | 1892 |
| 905757 | N/A | N/A | 9457 | 9472 | TTACATGCACGATCTC | kkk-d10-kkk | 1893 |
| 969419 | N/A | N/A | 9460 | 9475 | ACTTTACATGCACGAT | kk-d9-ekeke | 1742 |
| 905758 | N/A | N/A | 9461 | 9476 | CACTTTACATGCACGA | kkk-d10-kkk | 1733 |
| 969219 | N/A | N/A | 9461 | 9476 | CACTTTACATGCACGA | kk-d10-keke | 1733 |
| 971984 | N/A | N/A | 9461 | 9476 | CACTTTACATGCACGA | kk-d9-kekek | 1733 |
| 905808 | N/A | N/A | 10462 | 10477 | AATTTTATGGAACCTC | kkk-d10-kkk | 1894 |
| 971987 | N/A | N/A | 12076 | 12091 | TCATAGATACTCCTCA | kkk-d10-kkk | 1895 |
| 905867 | N/A | N/A | 12079 | 12094 | TCATCATAGATACTCC | kkk-d10-kkk | 1734 |
| 904016 | 1772 | 1787 | 13863 | 13878 | CCCTAACACTCAGTTC | kkk-d10-kkk | 1896 |
| 904084 | 2253 | 2268 | 14344 | 14359 | TCCGTCAATATATTCT | kkk-d10-kkk | 1897 |
| 904212 | 2709 | 2724 | 14800 | 14815 | GGTAAGAGCGATGGGA | kkk-d10-kkk | 1898 |

Deoxy, MOE, and cEt Gapmers

The newly designed chimeric antisense oligonucleotides in the Tables below were designed as deoxy, MOE, and cEt gapmers. The deoxy, MOE and cEt oligonucleotides have nucleosides that have either a MOE sugar modification, an(S)-cEt sugar modification, or a deoxy modification. The 'Chemistry' column describes the sugar modifications of each oligonucleotide. 'k' indicates an(S)-cEt sugar modification; 'd' indicates deoxyribose; and 'e' indicates a MOE modification. The internucleoside linkages throughout each gapmer are phosphorothioate (P=S) linkages. All cytosine residues throughout each gapmer are 5-methylcytosines. The sugar motifs of the gapmers are shown in the Chemistry columns of the tables below wherein 'k' means cEt sugar; 'e' means 2'-MOE sugar; 'd' means deoxy sugar, and the number after 'd' indicates the number of deoxy nucleosides.

"Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human APOL1 mRNA, designated herein as SEQ ID NO: 1 (GENBANK Accession No. NM_003661.3) or the human APOL1 genomic sequence, designated herein as SEQ ID NO: 2 (GENBANK Accession No. NT_011520.9 truncated from nucleotides 15986452 to 16001905). 'n/a' indicates that the antisense oligonucleotide does not target that a particular gene sequence with 100% complementarity.

The antisense oligonucleotides were tested in a series of experiments that had similar culture conditions. The results for each experiment are presented in separate tables shown below. Cultured A431 cells at a density of 5,000 cells per well were transfected by free uptake with 2,000 nM antisense oligonucleotide. After a treatment period of approximately 24 hours, RNA was isolated from the cells and APOL1 mRNA levels were measured by quantitative real-time PCR. Human primer probe set RTS35962 was used to measure mRNA levels. APOL1 mRNA levels were adjusted according to total RNA content, as measured by RIBOGREEN®. Results are presented as percent inhibition of APOL1, relative to untreated control cells.

TABLE 29

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 793406 | N/A | N/A | 8306 | 8321 | GTTCAAAAGCAGCATT | kkk-d10-kkk | 90 | 13 |
| 905095 | N/A | N/A | 6702 | 6717 | GTATTTCTTGATGTGG | kkk-d10-kkk | 99 | 413 |
| 905491 | N/A | N/A | 8237 | 8252 | GAGTATTGTTTTGTG | kkk-d10-kkk | 93 | 1899 |
| 905634 | N/A | N/A | 8744 | 8759 | ATTCTATTAGAGGGCT | kkk-d10-kkk | 95 | 1326 |
| 969064 | N/A | N/A | 6700 | 6715 | ATTTCTTGATGTGGTG | k-d10-kekek | 96 | 343 |
| 969084 | N/A | N/A | 5449 | 5464 | GTTATATTTGATCCTC | k-d10-kekek | 95 | 1900 |
| 969094 | N/A | N/A | 8321 | 8336 | GTTATGAAATTATTGG | k-d10-kekek | 73 | 76 |
| 969104 | 1031 | 1046 | 13122 | 13137 | AGATTGGCTCTGGCTC | k-d9-kekeke | 23 | 654 |
| 969114 | N/A | N/A | 8162 | 8177 | TTCAGAATTTCCACTA | k-d9-kekeke | 62 | 1186 |
| 969124 | N/A | N/A | 8306 | 8321 | GTTCAAAAGCAGCATT | k-d9-kekeke | 33 | 13 |
| 969134 | N/A | N/A | 5858 | 5873 | CAGTTTTGTAAGTGCA | k-d9-kekeke | 48 | 1577 |
| 969144 | N/A | N/A | 8743 | 8758 | TTCTATTAGAGGGCTA | k-d9-kekeke | 34 | 80 |
| 969154 | 2340 | 2355 | 14431 | 14446 | GTTCTAACTCTTGGGC | kek-d9-eekk | 86 | 243 |
| 969164 | N/A | N/A | 7922 | 7937 | GGAATTATGGAATTGC | kek-d9-eekk | 98 | 1249 |
| 969184 | N/A | N/A | 6547 | 6562 | TCAGATGGGTACTTCT | kk-d10-keke | 89 | 411 |
| 969194 | N/A | N/A | 8743 | 8758 | TTCTATTAGAGGGCTA | kk-d10-keke | 94 | 80 |
| 969204 | 2736 | 2751 | 14827 | 14842 | GCTAATTTTCTGACTG | kk-d10-keke | 99 | 1283 |
| 969214 | N/A | N/A | 8237 | 8252 | GAGTATTGTTTTGTG | kk-d10-keke | 96 | 1899 |
| 969224 | 2735 | 2750 | 14826 | 14841 | CTAATTTTCTGACTGT | kk-d8-eeeekk | 88 | 1901 |
| 969234 | N/A | N/A | 8163 | 8178 | ATTCAGAATTTCCACT | kk-d8-eeeekk | 64 | 1902 |
| 969244 | N/A | N/A | 8828 | 8843 | CTTTAAACTCAGGTGA | kk-d8-kekekk | 70 | 151 |
| 969254 | N/A | N/A | 6816 | 6831 | GCAATGCTGACTTGGC | kk-d8-kekekk | 91 | 1903 |
| 969274 | N/A | N/A | 6701 | 6716 | TATTTCTTGATGTGGT | kk-d8-kekekk | 71 | 1904 |
| 969294 | N/A | N/A | 5854 | 5869 | TTTGTAAGTGCAACCA | kk-d8-kekekk | 87 | 1095 |
| 969304 | N/A | N/A | 8366 | 8381 | CTTTATACCAGTGTCT | kk-d8-kekekk | 87 | 1890 |
| 969314 | N/A | N/A | 5449 | 5464 | GTTATATTTGATCCTC | kk-d9-eeekk | 93 | 1900 |
| 969324 | N/A | N/A | 8332 | 8347 | CACATCATTGGGTTAT | kk-d9-eeekk | 86 | 356 |
| 969334 | 1033 | 1048 | 13124 | 13139 | GAAGATTGGCTCTGGC | kk-d9-eeekk | 81 | 1480 |
| 969344 | N/A | N/A | 6818 | 6833 | ACGCAATGCTGACTTG | kk-d9-eeekk | 87 | 1905 |
| 969354 | N/A | N/A | 8831 | 8846 | AAGCTTTAAACTCAGG | kk-d9-eeekk | 95 | 1327 |
| 969364 | N/A | N/A | 6549 | 6564 | TATCAGATGGGTACTT | kk-d9-eeekk | 70 | 550 |

TABLE 29-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969384 | N/A | N/A | 5452 | 5467 | CGTGTTATATTTGATC | kk-d9-eeekk | 74 | 1906 |
| 969394 | N/A | N/A | 8335 | 8350 | CAACACATCATTGGGT | kk-d9-eeekk | 80 | 1907 |
| 969404 | N/A | N/A | 5449 | 5464 | GTTATATTTGATCCTC | kk-d9-ekeke | 96 | 1900 |
| 969414 | N/A | N/A | 8332 | 8347 | CACATCATTGGGTTAT | kk-d9-ekeke | 81 | 356 |
| 969424 | 1033 | 1048 | 13124 | 13139 | GAAGATTGGCTCTGGC | kk-d9-ekeke | 64 | 1480 |
| 969434 | N/A | N/A | 6818 | 6833 | ACGCAATGCTGACTTG | kk-d9-ekeke | 92 | 1919 |
| 969444 | N/A | N/A | 8832 | 8847 | GAAGCTTTAAACTCAG | kk-d9-ekeke | 62 | 1397 |
| 969454 | N/A | N/A | 5856 | 5871 | GTTTTGTAAGTGCAAC | kk-d9-ekeke | 86 | 1230 |
| 969464 | N/A | N/A | 8368 | 8383 | CACTTTATACCAGTGT | kk-d9-ekeke | 0 | 1908 |
| 969474 | N/A | N/A | 5448 | 5463 | TTATATTTGATCCTCA | kk-d9-kdkdk | 96 | 1909 |
| 969484 | N/A | N/A | 8320 | 8335 | TTATGAAATTATTGGT | kk-d9-kdkdk | 47 | 1910 |
| 969494 | 970 | 985 | 13061 | 13076 | AAGTATTGCCAGCTAA | kk-d9-kdkdk | 70 | 1911 |
| 969504 | N/A | N/A | 6702 | 6717 | GTATTTCTTGATGTGG | kk-d9-kdkdk | 87 | 413 |
| 971924 | N/A | N/A | 6547 | 6562 | TCAGATGGGTACTTCT | kk-d9-kekek | 82 | 411 |
| 971934 | N/A | N/A | 8743 | 8758 | TTCTATTAGAGGGCTA | kk-d9-kekek | 53 | 80 |
| 971944 | 2738 | 2753 | 14829 | 14844 | ATGCTAATTTTCTGAC | kk-d9-kekek | 97 | 1912 |
| 971954 | N/A | N/A | 8166 | 8181 | GGCATTCAGAATTTCC | kk-d9-kekek | 46 | 1913 |
| 971964 | N/A | N/A | 8306 | 8321 | GTTCAAAAGCAGCATT | kk-d9-kekek | 60 | 13 |
| 971974 | N/A | N/A | 6548 | 6563 | ATCAGATGGGTACTTC | kk-d9-kekek | 66 | 481 |
| 971994 | 1033 | 1048 | 13124 | 13139 | GAAGATTGGCTCTGGC | kkk-d8-kdkdk | 51 | 1480 |
| 972004 | N/A | N/A | 6702 | 6717 | GTATTTCTTGATGTGG | kkk-d8-kdkdk | 92 | 413 |
| 972014 | N/A | N/A | 8829 | 8844 | GCTTTAAACTCAGGTG | kkk-d8-kdkdk | 93 | 81 |
| 972024 | N/A | N/A | 5853 | 5868 | TTGTAAGTGCAACCAA | kkk-d8-kekek | 35 | 1025 |
| 972034 | N/A | N/A | 8365 | 8380 | TTTATACCAGTGTCTT | kkk-d8-kekek | 76 | 1914 |
| 972044 | 2253 | 2268 | 14344 | 14359 | TCCGTCAATATATTCT | kkk-d8-kekek | 95 | 1897 |
| 972054 | N/A | N/A | 6820 | 6835 | GAACGCAATGCTGACT | kkk-d8-kekek | 48 | 1888 |
| 972074 | N/A | N/A | 5854 | 5869 | TTTGTAAGTGCAACCA | kkk-d8-kekek | 63 | 1095 |
| 972084 | N/A | N/A | 8366 | 8381 | CTTTATACCAGTGTCT | kkk-d8-kekek | 76 | 1890 |
| 972094 | N/A | N/A | 5413 | 5428 | TATTCTCATGGTACAG | kkk-d9-keke | 68 | 1915 |
| 972104 | N/A | N/A | 8238 | 8253 | TGAGTATTGTTTTTGT | kkk-d9-keke | 92 | 1916 |
| 972114 | 970 | 985 | 13061 | 13076 | AAGTATTGCCAGCTAA | kkk-d9-keke | 63 | 1911 |
| 972124 | N/A | N/A | 6702 | 6717 | GTATTTCTTGATGTGG | kkk-d9-keke | 98 | 413 |
| 972144 | N/A | N/A | 5857 | 5872 | AGTTTTGTAAGTGCAA | kkk-d9-kkke | 96 | 1917 |
| 972154 | N/A | N/A | 8742 | 8757 | TCTATTAGAGGGCTAG | kkk-d9-kkke | 51 | 150 |
| 972164 | 2340 | 2355 | 14431 | 14446 | GTTCTAACTCTTGGGC | kkk-d9-kkke | 58 | 243 |
| 972174 | N/A | N/A | 8164 | 8179 | CATTCAGAATTTCCAC | kkk-d9-kkke | 92 | 1730 |

TABLE 29-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 972184 | 971 | 986 | 13062 | 13077 | TAAGTATTGCCAGCTA | kkk-d9-kkke | 65 | 1918 |
| 972194 | N/A | N/A | 6819 | 6834 | AACGCAATGCTGACTT | kkk-d9-kkke | 91 | 1919 |

TABLE 30

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 793444 | N/A | N/A | 8830 | 8845 | AGCTTTAAACTCAGGT | kkk-d10-kkk | 68 | 1920 |
| 905095 | N/A | N/A | 6702 | 6717 | GTATTTCTTGATGTGG | kkk-d10-kkk | 99 | 413 |
| 905491 | N/A | N/A | 8237 | 8252 | GAGTATTGTTTTGTG | kkk-d10-kkk | 94 | 1899 |
| 969055 | N/A | N/A | 8828 | 8843 | CTTTAAACTCAGGTGA | k-d10-kekek | 77 | 151 |
| 969065 | N/A | N/A | 6816 | 6831 | GCAATGCTGACTTGGC | k-d10-kekek | 85 | 1903 |
| 969085 | N/A | N/A | 5450 | 5465 | TGTTATATTTGATCCT | k-d10-kekek | 79 | 1887 |
| 969095 | N/A | N/A | 8333 | 8348 | ACACATCATTGGGTTA | k-d10-kekek | 47 | 426 |
| 969105 | N/A | N/A | 5410 | 5425 | TCTCATGGTACAGGAG | k-d9-kekeke | 55 | 537 |
| 969115 | N/A | N/A | 8235 | 8250 | GTATTGTTTTGTGGG | k-d9-kekeke | 70 | 1921 |
| 969125 | 970 | 985 | 13061 | 13076 | AAGTATTGCCAGCTAA | k-d9-kekeke | 25 | 1911 |
| 969135 | N/A | N/A | 6548 | 6563 | ATCAGATGGGTACTTC | k-d9-kekeke | 43 | 481 |
| 969145 | N/A | N/A | 8744 | 8759 | ATTCTATTAGAGGGCT | k-d9-kekeke | 34 | 1326 |
| 969155 | 2736 | 2751 | 14827 | 14842 | GCTAATTTTCTGACTG | kek-d9-eekk | 94 | 1283 |
| 969165 | N/A | N/A | 8164 | 8179 | CATTCAGAATTTCCAC | kek-d9-eekk | 89 | 1730 |
| 969175 | N/A | N/A | 8829 | 8844 | GCTTTAAACTCAGGTG | kk-d10-keke | 91 | 81 |
| 969185 | N/A | N/A | 6701 | 6716 | TATTTCTTGATGTGGT | kk-d10-keke | 99 | 1904 |
| 969195 | N/A | N/A | 8828 | 8843 | CTTTAAACTCAGGTGA | kk-d10-keke | 87 | 151 |
| 969205 | N/A | N/A | 5412 | 5427 | ATTCTCATGGTACAGG | kk-d10-keke | 95 | 677 |
| 969215 | N/A | N/A | 8321 | 8336 | GTTATGAAATTATTGG | kk-d10-keke | 68 | 76 |
| 969225 | N/A | N/A | 5411 | 5426 | TTCTCATGGTACAGGA | kk-d8-eeeekk | 80 | 607 |
| 969235 | N/A | N/A | 8236 | 8251 | AGTATTGTTTTGTGG | kk-d8-eeeekk | 85 | 1922 |
| 969245 | 968 | 983 | 13059 | 13074 | GTATTGCCAGCTAAGG | kk-d8-kekekk | 74 | 1410 |
| 969255 | N/A | N/A | 7920 | 7935 | AATTATGGAATTGCAG | kk-d8-kekekk | 35 | 1923 |
| 969265 | N/A | N/A | 8829 | 8844 | GCTTTAAACTCAGGTG | kk-d8-kekekk | 50 | 81 |
| 969275 | N/A | N/A | 6817 | 6832 | CGCAATGCTGACTTGG | kk-d8-kekekk | 60 | 1924 |
| 969285 | N/A | N/A | 8830 | 8845 | AGCTTTAAACTCAGGT | kk-d8-kekekk | 16 | 1920 |
| 969295 | N/A | N/A | 5858 | 5873 | CAGTTTTGTAAGTGCA | kk-d8-kekekk | 18 | 1577 |
| 969305 | N/A | N/A | 8744 | 8759 | ATTCTATTAGAGGGCT | kk-d8-kekekk | 34 | 1326 |

TABLE 30-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969315 | N/A | N/A | 5853 | 5868 | TTGTAAGTGCAACCAA | kk-d9-eeekk | 83 | 1025 |
| 969325 | N/A | N/A | 8365 | 8380 | TTTATACCAGTGTCTT | kk-d9-eeekk | 88 | 1914 |
| 969335 | 2251 | 2266 | 14342 | 14357 | CGTCAATATATTCTTT | kk-d9-eeekk | 81 | 1925 |
| 969345 | N/A | N/A | 7922 | 7937 | GGAATTATGGAATTGC | kk-d9-eeekk | 99 | 1249 |
| 969355 | N/A | N/A | 8307 | 8322 | GGTTCAAAAGCAGCAT | kk-d9-eeekk | 95 | 978 |
| 969365 | N/A | N/A | 6703 | 6718 | TGTATTTCTTGATGTG | kk-d9-eeekk | 87 | 1926 |
| 969385 | N/A | N/A | 5856 | 5871 | GTTTTGTAAGTGCAAC | kk-d9-eeekk | 83 | 1230 |
| 969395 | N/A | N/A | 8368 | 8383 | CACTTTATACCAGTGT | kk-d9-eeekk | 0 | 1908 |
| 969405 | N/A | N/A | 5853 | 5868 | TTGTAAGTGCAACCAA | kk-d9-ekeke | 87 | 1025 |
| 969415 | N/A | N/A | 8365 | 8380 | TTTATACCAGTGTCTT | kk-d9-ekeke | 90 | 1914 |
| 969425 | 2251 | 2266 | 14342 | 14357 | CGTCAATATATTCTTT | kk-d9-ekeke | 90 | 1925 |
| 969435 | N/A | N/A | 7922 | 7937 | GGAATTATGGAATTGC | kk-d9-ekeke | 97 | 1249 |
| 969445 | N/A | N/A | 8308 | 8323 | TGGTTCAAAAGCAGCA | kk-d9-ekeke | 82 | 1048 |
| 969455 | N/A | N/A | 5860 | 5875 | GGCAGTTTTGTAAGTG | kk-d9-ekeke | 75 | 123 |
| 969465 | N/A | N/A | 8745 | 8760 | AATTCTATTAGAGGGC | kk-d9-ekeke | 79 | 1396 |
| 969475 | N/A | N/A | 5449 | 5464 | GTTATATTTGATCCTC | kk-d9-kdkdk | 93 | 1900 |
| 969485 | N/A | N/A | 8332 | 8347 | CACATCATTGGGTTAT | kk-d9-kdkdk | 79 | 356 |
| 969495 | 1033 | 1048 | 13124 | 13139 | GAAGATTGGCTCTGGC | kk-d9-kdkdk | 79 | 1480 |
| 969505 | N/A | N/A | 6818 | 6833 | ACGCAATGCTGACTTG | kk-d9-kdkdk | 85 | 1905 |
| 971915 | N/A | N/A | 8829 | 8844 | GCTTTAAACTCAGGTG | kk-d9-kekek | 86 | 81 |
| 971925 | N/A | N/A | 6701 | 6716 | TATTTCTTGATGTGGT | kk-d9-kekek | 97 | 1904 |
| 971935 | N/A | N/A | 8828 | 8843 | CTTTAAACTCAGGTGA | kk-d9-kekek | 82 | 151 |
| 971945 | N/A | N/A | 5414 | 5429 | TTATTCTCATGGTACA | kk-d9-kekek | 47 | 1927 |
| 971955 | N/A | N/A | 8239 | 8254 | GTGAGTATTGTTTTTG | kk-d9-kekek | 88 | 1928 |
| 971965 | 970 | 985 | 13061 | 13076 | AAGTATTGCCAGCTAA | kk-d9-kekek | 62 | 1911 |
| 971975 | N/A | N/A | 6702 | 6717 | GTATTTCTTGATGTGG | kk-d9-kekek | 75 | 413 |
| 971995 | 2251 | 2266 | 14342 | 14357 | CGTCAATATATTCTTT | kkk-d8-kdkdk | 95 | 1925 |
| 972005 | N/A | N/A | 6818 | 6833 | ACGCAATGCTGACTTG | kkk-d8-kdkdk | 70 | 1905 |
| 972025 | N/A | N/A | 5857 | 5872 | AGTTTTGTAAGTGCAA | kkk-d8-kekek | 77 | 1917 |
| 972035 | N/A | N/A | 8742 | 8757 | TCTATTAGAGGGCTAG | kkk-d8-kekek | 23 | 150 |
| 972045 | 2342 | 2357 | 14433 | 14448 | CTGTTCTAACTCTTGG | kkk-d8-kekek | 88 | 383 |
| 972055 | N/A | N/A | 7924 | 7939 | TGGGAATTATGGAATT | kkk-d8-kekek | 56 | 1929 |
| 972065 | N/A | N/A | 8830 | 8845 | AGCTTTAAACTCAGGT | kkk-d8-kekek | 64 | 1920 |
| 972075 | N/A | N/A | 5858 | 5873 | CAGTTTTGTAAGTGCA | kkk-d8-kekek | 87 | 1577 |
| 972085 | N/A | N/A | 8744 | 8759 | ATTCTATTAGAGGGCT | kkk-d8-kekek | 37 | 1326 |
| 972095 | N/A | N/A | 5450 | 5465 | TGTTATATTTGATCCT | kkk-d9-keke | 71 | 1887 |
| 972105 | N/A | N/A | 8322 | 8337 | GGTTATGAAATTATTG | kkk-d9-keke | 88 | 1930 |

TABLE 30-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 972115 | 1033 | 1048 | 13124 | 13139 | GAAGATTGGCTCTGGC | kkk-d9-keke | 75 | 1480 |
| 972125 | N/A | N/A | 6818 | 6833 | ACGCAATGCTGACTTG | kkk-d9-keke | 87 | 1905 |
| 972145 | N/A | N/A | 6547 | 6562 | TCAGATGGGTACTTCT | kkk-d9-kkke | 82 | 411 |
| 972155 | N/A | N/A | 8743 | 8758 | TTCTATTAGAGGGCTA | kkk-d9-kkke | 85 | 80 |
| 972165 | 2736 | 2751 | 14827 | 14842 | GCTAATTTTCTGACTG | kkk-d9-kkke | 92 | 1283 |
| 972175 | N/A | N/A | 8237 | 8252 | GAGTATTGTTTTGTG | kkk-d9-kkke | 88 | 1899 |
| 972185 | 1034 | 1049 | 13125 | 13140 | TGAAGATTGGCTCTGG | kkk-d9-kkke | 61 | 1931 |
| 972195 | N/A | N/A | 7923 | 7938 | GGGAATTATGGAATTG | kkk-d9-kkke | 77 | 1596 |

TABLE 31

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 903822 | 970 | 985 | 13061 | 13076 | AAGTATTGCCAGCTAA | kkk-d10-kkk | 90 | 1911 |
| 905095 | N/A | N/A | 6702 | 6717 | GTATTTCTTGATGTGG | kkk-d10-kkk | 100 | 413 |
| 905491 | N/A | N/A | 8237 | 8252 | GAGTATTGTTTTGTG | kkk-d10-kkk | 94 | 1899 |
| 969056 | 968 | 983 | 13059 | 13074 | GTATTGCCAGCTAAGG | k-d10-kekek | 93 | 1410 |
| 969066 | N/A | N/A | 7920 | 7935 | AATTATGGAATTGCAG | k-d10-kekek | 52 | 1923 |
| 969076 | N/A | N/A | 8830 | 8845 | AGCTTTAAACTCAGGT | k-d10-kekek | 95 | 1920 |
| 969086 | N/A | N/A | 5854 | 5869 | TTTGTAAGTGCAACCA | k-d10-kekek | 99 | 1095 |
| 969096 | N/A | N/A | 8366 | 8381 | CTTTATACCAGTGTCT | k-d10-kekek | 89 | 1890 |
| 969106 | N/A | N/A | 5447 | 5462 | TATATTTGATCCTCAA | k-d9-kekeke | 75 | 1932 |
| 969116 | N/A | N/A | 8331 | 8346 | ACATCATTGGGTTATG | k-d9-kekeke | 76 | 286 |
| 969126 | 1033 | 1048 | 13124 | 13139 | GAAGATTGGCTCTGGC | k-d9-kekeke | 21 | 1480 |
| 969136 | N/A | N/A | 6702 | 6717 | GTATTTCTTGATGTGG | k-d9-kekeke | 87 | 413 |
| 969146 | N/A | N/A | 8829 | 8844 | GCTTTAAACTCAGGTG | k-d9-kekeke | 67 | 81 |
| 969156 | N/A | N/A | 5412 | 5427 | ATTCTCATGGTACAGG | kek-d9-eekk | 96 | 677 |
| 969166 | N/A | N/A | 8237 | 8252 | GAGTATTGTTTTGTG | kek-d9-eekk | 90 | 1899 |
| 969176 | 969 | 984 | 13060 | 13075 | AGTATTGCCAGCTAAG | kk-d10-keke | 86 | 1479 |
| 969186 | N/A | N/A | 6817 | 6832 | CGCAATGCTGACTTGG | kk-d10-keke | 96 | 1924 |
| 969206 | N/A | N/A | 5450 | 5465 | TGTTATATTTGATCCT | kk-d10-keke | 92 | 1887 |
| 969216 | N/A | N/A | 8333 | 8348 | ACACATCATTGGGTTA | kk-d10-keke | 72 | 426 |
| 969226 | N/A | N/A | 5448 | 5463 | TTATATTTGATCCTCA | kk-d8-eeeekk | 91 | 1909 |
| 969236 | N/A | N/A | 8320 | 8335 | TTATGAAATTATTGGT | kk-d8-eeeekk | 35 | 1910 |
| 969246 | 1031 | 1046 | 13122 | 13137 | AGATTGGCTCTGGCTC | kk-d8-kekekk | 18 | 654 |

TABLE 31-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969256 | N/A | N/A | 8162 | 8177 | TTCAGAATTTCCACTA | kk-d8-kekekk | 58 | 1186 |
| 969266 | 969 | 984 | 13060 | 13075 | AGTATTGCCAGCTAAG | kk-d8-kekekk | 34 | 1479 |
| 969276 | N/A | N/A | 7921 | 7936 | GAATTATGGAATTGCA | kk-d8-kekekk | 61 | 1183 |
| 969286 | N/A | N/A | 8306 | 8321 | GTTCAAAAGCAGCATT | kk-d8-kekekk | 34 | 13 |
| 969296 | N/A | N/A | 6548 | 6563 | ATCAGATGGGTACTTC | kk-d8-kekekk | 45 | 481 |
| 969316 | N/A | N/A | 5857 | 5872 | AGTTTTGTAAGTGCAA | kk-d9-eeekk | 94 | 1917 |
| 969326 | N/A | N/A | 8742 | 8757 | TCTATTAGAGGGCTAG | kk-d9-eeekk | 67 | 150 |
| 969336 | 2340 | 2355 | 14431 | 14446 | GTTCTAACTCTTGGGC | kk-d9-eeekk | 91 | 243 |
| 969346 | N/A | N/A | 8164 | 8179 | CATTCAGAATTTCCAC | kk-d9-eeekk | 78 | 1730 |
| 969356 | 971 | 986 | 13062 | 13077 | TAAGTATTGCCAGCTA | kk-d9-eeekk | 79 | 1918 |
| 969366 | N/A | N/A | 6819 | 6834 | AACGCAATGCTGACTT | kk-d9-eeekk | 82 | 1919 |
| 969376 | N/A | N/A | 8832 | 8847 | GAAGCTTTAAACTCAG | kk-d9-eeekk | 72 | 1397 |
| 969386 | N/A | N/A | 5860 | 5875 | GGCAGTTTTGTAAGTG | kk-d9-eeekk | 80 | 123 |
| 969396 | N/A | N/A | 8746 | 8761 | TAATTCTATTAGAGGG | kk-d9-eeekk | 59 | 220 |
| 969406 | N/A | N/A | 5857 | 5872 | AGTTTTGTAAGTGCAA | kk-d9-ekeke | 91 | 1917 |
| 969416 | N/A | N/A | 8742 | 8757 | TCTATTAGAGGGCTAG | kk-d9-ekeke | 67 | 150 |
| 969426 | 2340 | 2355 | 14431 | 14446 | GTTCTAACTCTTGGGC | kk-d9-ekeke | 78 | 243 |
| 969436 | N/A | N/A | 8164 | 8179 | CATTCAGAATTTCCAC | kk-d9-ekeke | 87 | 1730 |
| 969446 | 972 | 987 | 13063 | 13078 | GTAAGTATTGCCAGCT | kk-d9-ekeke | 69 | 1933 |
| 969456 | N/A | N/A | 6550 | 6565 | ATATCAGATGGGTACT | kk-d9-ekeke | 27 | 620 |
| 969466 | N/A | N/A | 8746 | 8761 | TAATTCTATTAGAGGG | kk-d9-ekeke | 46 | 220 |
| 969476 | N/A | N/A | 5853 | 5868 | TTGTAAGTGCAACCAA | kk-d9-kdkdk | 74 | 1025 |
| 969486 | N/A | N/A | 8365 | 8380 | TTTATACCAGTGTCTT | kk-d9-kdkdk | 81 | 1914 |
| 969496 | 2251 | 2266 | 14342 | 14357 | CGTCAATATATTCTTT | kk-d9-kdkdk | 91 | 1925 |
| 969506 | N/A | N/A | 7922 | 7937 | GGAATTATGGAATTGC | kk-d9-kdkdk | 89 | 1249 |
| 971916 | 969 | 984 | 13060 | 13075 | AGTATTGCCAGCTAAG | kk-d9-kekek | 65 | 1479 |
| 971926 | N/A | N/A | 6817 | 6832 | CGCAATGCTGACTTGG | kk-d9-kekek | 83 | 1924 |
| 971946 | N/A | N/A | 5451 | 5466 | GTGTTATATTTGATCC | kk-d9-kekek | 78 | 1934 |
| 971956 | N/A | N/A | 8323 | 8338 | GGGTTATGAAATTATT | kk-d9-kekek | 84 | 1935 |
| 971966 | 1033 | 1048 | 13124 | 13139 | GAAGATTGGCTCTGGC | kk-d9-kekek | 48 | 1480 |
| 971976 | N/A | N/A | 6818 | 6833 | ACGCAATGCTGACTTG | kk-d9-kekek | 79 | 1905 |
| 971996 | 2340 | 2355 | 14431 | 14446 | GTTCTAACTCTTGGGC | kkk-d8-kdkdk | 73 | 243 |
| 972006 | N/A | N/A | 7922 | 7937 | GGAATTATGGAATTGC | kkk-d8-kdkdk | 76 | 1249 |
| 972026 | N/A | N/A | 6547 | 6562 | TCAGATGGGTACTTCT | kkk-d8-kekek | 50 | 411 |
| 972036 | N/A | N/A | 8743 | 8758 | TTCTATTAGAGGGCTA | kkk-d8-kekek | 42 | 80 |
| 972046 | 2738 | 2753 | 14829 | 14844 | ATGCTAATTTTCTGAC | kkk-d8-kekek | 95 | 1912 |
| 972056 | N/A | N/A | 8166 | 8181 | GGCATTCAGAATTTCC | kkk-d8-kekek | 20 | 1913 |

TABLE 31-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 972066 | N/A | N/A | 8306 | 8321 | GTTCAAAAGCAGCATT | kkk-d8-kekek | 24 | 13 |
| 972076 | N/A | N/A | 6548 | 6563 | ATCAGATGGGTACTTC | kkk-d8-kekek | 54 | 481 |
| 972096 | N/A | N/A | 5451 | 5466 | GTGTTATATTTGATCC | kkk-d9-keke | 96 | 1981 |
| 972106 | N/A | N/A | 8334 | 8349 | AACACATCATTGGGTT | kkk-d9-keke | 21 | 496 |
| 972116 | 2251 | 2266 | 14342 | 14357 | CGTCAATATATTCTTT | kkk-d9-keke | 94 | 1925 |
| 972126 | N/A | N/A | 7922 | 7937 | GGAATTATGGAATTGC | kkk-d9-keke | 55 | 1249 |
| 972136 | N/A | N/A | 8829 | 8844 | GCTTTAAACTCAGGTG | kkk-d9-kkke | 74 | 81 |
| 972146 | N/A | N/A | 6701 | 6716 | TATTTCTTGATGTGGT | kkk-d9-kkke | 99 | 1904 |
| 972156 | N/A | N/A | 8828 | 8843 | CTTTAAACTCAGGTGA | kkk-d9-kkke | 59 | 151 |
| 972166 | N/A | N/A | 5412 | 5427 | ATTCTCATGGTACAGG | kkk-d9-kkke | 93 | 677 |
| 972176 | N/A | N/A | 8321 | 8336 | GTTATGAAATTATTGG | kkk-d9-kkke | 96 | 76 |
| 972186 | 2252 | 2267 | 14343 | 14358 | CCGTCAATATATTCTT | kkk-d9-kkke | 98 | 1936 |
| 972196 | N/A | N/A | 8165 | 8180 | GCATTCAGAATTTCCA | kkk-d9-kkke | 95 | 1937 |

TABLE 32

Inhibition of APOL1 mRNA by deoxy MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 904082 | 2251 | 2266 | 14342 | 14357 | CGTCAATATATTCTTT | kkk-d10-kkk | 94 | 1925 |
| 905095 | N/A | N/A | 6702 | 6717 | GTATTTCTTGATGTGG | kkk-d10-kkk | 100 | 413 |
| 905491 | N/A | N/A | 8237 | 8252 | GAGTATTGTTTTTGTG | kkk-d10-kkk | 94 | 1899 |
| 969057 | 1031 | 1046 | 13122 | 13137 | AGATTGGCTCTGGCTC | k-d10-kekek | 40 | 654 |
| 969067 | N/A | N/A | 8162 | 8177 | TTCAGAATTTCCACTA | k-d10-kekek | 87 | 1186 |
| 969077 | N/A | N/A | 8306 | 8321 | GTTCAAAAGCAGCATT | k-d10-kekek | 79 | 13 |
| 969087 | N/A | N/A | 5858 | 5873 | CAGTTTTGTAAGTGCA | k-d10-kekek | 92 | 1577 |
| 969097 | N/A | N/A | 8743 | 8758 | TTCTATTAGAGGGCTA | k-d10-kekek | 45 | 80 |
| 969107 | N/A | N/A | 5448 | 5463 | TTATATTTGATCCTCA | k-d9-kekeke | 39 | 1909 |
| 969117 | N/A | N/A | 8364 | 8379 | TTATACCAGTGTCTTC | k-d9-kekeke | 82 | 1938 |
| 969127 | 2251 | 2266 | 14342 | 14357 | CGTCAATATATTCTTT | k-d9-kekeke | 96 | 1925 |
| 969137 | N/A | N/A | 6818 | 6833 | ACGCAATGCTGACTTG | k-d9-kekeke | 72 | 1905 |
| 969157 | N/A | N/A | 5449 | 5464 | GTTATATTTGATCCTC | kek-d9-eekk | 99 | 1900 |
| 969167 | N/A | N/A | 8321 | 8336 | GTTATGAAATTATTGG | kek-d9-eekk | 90 | 76 |
| 969177 | 1032 | 1047 | 13123 | 13138 | AAGATTGGCTCTGGCT | kk-d10-keke | 65 | 1411 |
| 969187 | N/A | N/A | 7921 | 7936 | GAATTATGGAATTGCA | kk-d10-keke | 92 | 1183 |
| 969207 | N/A | N/A | 5854 | 5869 | TTTGTAAGTGCAACCA | kk-d10-keke | 92 | 1095 |

TABLE 32-continued

Inhibition of APOL1 mRNA by deoxy MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969217 | N/A | N/A | 8366 | 8381 | CTTTATACCAGTGTCT | kk-d10-keke | 97 | 1890 |
| 969227 | N/A | N/A | 5449 | 5464 | GTTATATTTGATCCTC | kk-d8-eeeekk | 69 | 1900 |
| 969237 | N/A | N/A | 8332 | 8347 | CACATCATTGGGTTAT | kk-d8-eeeekk | 54 | 356 |
| 969247 | N/A | N/A | 5410 | 5425 | TCTCATGGTACAGGAG | kk-d8-kekekk | 26 | 537 |
| 969257 | N/A | N/A | 8235 | 8250 | GTATTGTTTTGTGGG | kk-d8-kekekk | 39 | 1921 |
| 969267 | 1032 | 1047 | 13123 | 13138 | AAGATTGGCTCTGGCT | kk-d8-kekekk | 2 | 1411 |
| 969277 | N/A | N/A | 8163 | 8178 | ATTCAGAATTTCCACT | kk-d8-kekekk | 57 | 1902 |
| 969287 | 970 | 985 | 13061 | 13076 | AAGTATTGCCAGCTAA | kk-d8-kekekk | 27 | 1911 |
| 969297 | N/A | N/A | 6702 | 6717 | GTATTCTTGATGTGG | kk-d8-kekekk | 52 | 413 |
| 969317 | N/A | N/A | 6547 | 6562 | TCAGATGGGTACTTCT | kk-d9-eeekk | 88 | 411 |
| 969327 | N/A | N/A | 8743 | 8758 | TTCTATTAGAGGGCTA | kk-d9-eeekk | 87 | 80 |
| 969337 | 2736 | 2751 | 14827 | 14842 | GCTAATTTTCTGACTG | kk-d9-eeekk | 94 | 1283 |
| 969347 | N/A | N/A | 8237 | 8252 | GAGTATTGTTTTTGTG | kk-d9-eeekk | 97 | 1899 |
| 969357 | 1034 | 1049 | 13125 | 13140 | TGAAGATTGGCTCTGG | kk-d9-eeekk | 82 | 1931 |
| 969367 | N/A | N/A | 7923 | 7938 | GGGAATTATGGAATTG | kk-d9-eeekk | 86 | 1596 |
| 969377 | N/A | N/A | 8308 | 8323 | TGGTTCAAAAGCAGCA | kk-d9-eeekk | 93 | 1048 |
| 969387 | N/A | N/A | 6550 | 6565 | ATATCAGATGGGTACT | kk-d9-eeekk | 52 | 620 |
| 969407 | N/A | N/A | 6547 | 6562 | TCAGATGGGTACTTCT | kk-d9-ekeke | 91 | 411 |
| 969417 | N/A | N/A | 8743 | 8758 | TTCTATTAGAGGGCTA | kk-d9-ekeke | 85 | 80 |
| 969427 | 2736 | 2751 | 14827 | 14842 | GCTAATTTTCTGACTG | kk-d9-ekeke | 88 | 1283 |
| 969437 | N/A | N/A | 8237 | 8252 | GAGTATTGTTTTTGTG | kk-d9-ekeke | 98 | 1899 |
| 969447 | 1035 | 1050 | 13126 | 13141 | CTGAAGATTGGCTCTG | kk-d9-ekeke | 53 | 1939 |
| 969457 | N/A | N/A | 6704 | 6719 | GTGTATTCTTGATGT | kk-d9-ekeke | 94 | 1940 |
| 969467 | N/A | N/A | 8831 | 8846 | AAGCTTTAAACTCAGG | kk-d9-ekeke | 95 | 1327 |
| 969477 | N/A | N/A | 5857 | 5872 | AGTTTTGTAAGTGCAA | kk-d9-kdkdk | 91 | 1917 |
| 969487 | N/A | N/A | 8742 | 8757 | TCTATTAGAGGGCTAG | kk-d9-kdkdk | 68 | 150 |
| 969497 | 2340 | 2355 | 14431 | 14446 | GTTCTAACTCTTGGGC | kk-d9-kdkdk | 90 | 243 |
| 969507 | N/A | N/A | 8164 | 8179 | CATTCAGAATTTCCAC | kk-d9-kdkdk | 84 | 1730 |
| 971917 | 1032 | 1047 | 13123 | 13138 | AAGATTGGCTCTGGCT | kk-d9-kekek | 37 | 1411 |
| 971927 | N/A | N/A | 7921 | 7936 | GAATTATGGAATTGCA | kk-d9-kekek | 51 | 1183 |
| 971947 | N/A | N/A | 5452 | 5467 | CGTGTTATATTTGATC | kk-d9-kekek | 88 | 1906 |
| 971957 | N/A | N/A | 8335 | 8350 | CAACACATCATTGGGT | kk-d9-kekek | 43 | 1907 |
| 971967 | 2251 | 2266 | 14342 | 14357 | CGTCAATATATTCTTT | kk-d9-kekek | 94 | 1925 |
| 971977 | N/A | N/A | 7922 | 7937 | GGAATTATGGAATTGC | kk-d9-kekek | 82 | 1249 |
| 971997 | 2736 | 2751 | 14827 | 14842 | GCTAATTTTCTGACTG | kkk-d8-kdkdk | 93 | 1283 |
| 972007 | N/A | N/A | 8164 | 8179 | CATTCAGAATTTCCAC | kkk-d8-kdkdk | 88 | 1730 |
| 972017 | N/A | N/A | 8829 | 8844 | GCTTTAAACTCAGGTG | kkk-d8-kekek | 68 | 81 |

TABLE 32-continued

Inhibition of APOL1 mRNA by deoxy MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 972027 | N/A | N/A | 6701 | 6716 | TATTTCTTGATGTGGT | kkk-d8-kekek | 95 | 1904 |
| 972037 | N/A | N/A | 8828 | 8843 | CTTTAAACTCAGGTGA | kkk-d8-kekek | 40 | 151 |
| 972047 | N/A | N/A | 5414 | 5429 | TTATTCTCATGGTACA | kkk-d8-kekek | 53 | 1927 |
| 972057 | N/A | N/A | 8239 | 8254 | GTGAGTATTGTTTTTG | kkk-d8-kekek | 85 | 1928 |
| 972067 | 970 | 985 | 13061 | 13076 | AAGTATTGCCAGCTAA | kkk-d8-kekek | 47 | 1911 |
| 972077 | N/A | N/A | 6702 | 6717 | GTATTTCTTGATGTGG | kkk-d8-kekek | 73 | 413 |
| 972097 | N/A | N/A | 5855 | 5870 | TTTTGTAAGTGCAACC | kkk-d9-keke | 98 | 1164 |
| 972107 | N/A | N/A | 8367 | 8382 | ACTTTATACCAGTGTC | kkk-d9-keke | 65 | 1941 |
| 972117 | 2340 | 2355 | 14431 | 14446 | GTTCTAACTCTTGGGC | kkk-d9-keke | 66 | 243 |
| 972127 | N/A | N/A | 8164 | 8179 | CATTCAGAATTTCCAC | kkk-d9-keke | 86 | 1730 |
| 972137 | 969 | 984 | 13060 | 13075 | AGTATTGCCAGCTAAG | kkk-d9-kkke | 89 | 1479 |
| 972147 | N/A | N/A | 6817 | 6832 | CGCAATGCTGACTTGG | kkk-d9-kkke | 94 | 1924 |
| 972167 | N/A | N/A | 5450 | 5465 | TGTTATATTTGATCCT | kkk-d9-kkke | 89 | 1887 |
| 972177 | N/A | N/A | 8333 | 8348 | ACACATCATTGGGTTA | kkk-d9-kkke | 59 | 426 |
| 972187 | 2341 | 2356 | 14432 | 14447 | TGTTCTAACTCTTGGG | kkk-d9-kkke | 89 | 313 |
| 972197 | N/A | N/A | 8238 | 8253 | TGAGTATTGTTTTTGT | kkk-d9-kkke | 95 | 1916 |

TABLE 33

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 904619 | N/A | N/A | 5412 | 5427 | ATTCTCATGGTACAGG | kkk-d10-kkk | 97 | 677 |
| 905095 | N/A | N/A | 6702 | 6717 | GTATTTCTTGATGTGG | kkk-d10-kkk | 100 | 413 |
| 905491 | N/A | N/A | 8237 | 8252 | GAGTATTGTTTTTGTG | kkk-d10-kkk | 94 | 1899 |
| 969058 | N/A | N/A | 5410 | 5425 | TCTCATGGTACAGGAG | k-d10-kekek | 61 | 537 |
| 969068 | N/A | N/A | 8235 | 8250 | GTATTGTTTTTGTGGG | k-d10-kekek | 77 | 1921 |
| 969078 | 970 | 985 | 13061 | 13076 | AAGTATTGCCAGCTAA | k-d10-kekek | 54 | 1911 |
| 969088 | N/A | N/A | 6548 | 6563 | ATCAGATGGGTACTTC | k-d10-kekek | 73 | 481 |
| 969098 | N/A | N/A | 8744 | 8759 | ATTCTATTAGAGGGCT | k-d10-kekek | 45 | 1326 |
| 969108 | N/A | N/A | 5852 | 5867 | TGTAAGTGCAACCAAT | k-d9-kekeke | 67 | 955 |
| 969118 | N/A | N/A | 8741 | 8756 | CTATTAGAGGGCTAGT | k-d9-kekeke | 34 | 1674 |
| 969128 | 2340 | 2355 | 14431 | 14446 | GTTCTAACTCTTGGGC | k-d9-kekeke | 77 | 243 |
| 969138 | N/A | N/A | 7922 | 7937 | GGAATTATGGAATTGC | k-d9-kekeke | 88 | 1249 |
| 969158 | N/A | N/A | 5450 | 5465 | TGTTATATTTGATCCT | kek-d9-eekk | 94 | 1887 |
| 969168 | N/A | N/A | 8333 | 8348 | ACACATCATTGGGTTA | kek-d9-eekk | 87 | 426 |

TABLE 33-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969178 | 2735 | 2750 | 14826 | 14841 | CTAATTTTCTGACTGT | kk-d10-keke | 98 | 1901 |
| 969188 | N/A | N/A | 8163 | 8178 | ATTCAGAATTTCCACT | kk-d10-keke | 88 | 1902 |
| 969198 | N/A | N/A | 8830 | 8845 | AGCTTTAAACTCAGGT | kk-d10-keke | 94 | 1920 |
| 969208 | N/A | N/A | 5858 | 5873 | CAGTTTTGTAAGTGCA | kk-d10-keke | 94 | 1577 |
| 969218 | N/A | N/A | 8744 | 8759 | ATTCTATTAGAGGGCT | kk-d10-keke | 78 | 1326 |
| 969228 | N/A | N/A | 5853 | 5868 | TTGTAAGTGCAACCAA | kk-d8-eeeekk | 70 | 1025 |
| 969238 | N/A | N/A | 8365 | 8380 | TTTATACCAGTGTCTT | kk-d8-eeeekk | 89 | 1914 |
| 969248 | N/A | N/A | 5447 | 5462 | TATATTTGATCCTCAA | kk-d8-kekekk | 77 | 1932 |
| 969258 | N/A | N/A | 8331 | 8346 | ACATCATTGGGTTATG | kk-d8-kekekk | 70 | 286 |
| 969268 | 2735 | 2750 | 14826 | 14841 | CTAATTTTCTGACTGT | kk-d8-kekekk | 71 | 1901 |
| 969278 | N/A | N/A | 8236 | 8251 | AGTATTGTTTTGTGG | kk-d8-kekekk | 66 | 1922 |
| 969288 | 1033 | 1048 | 13124 | 13139 | GAAGATTGGCTCTGGC | kk-d8-kekekk | 10 | 1480 |
| 969298 | N/A | N/A | 6818 | 6833 | ACGCAATGCTGACTTG | kk-d8-kekekk | 72 | 1905 |
| 969308 | N/A | N/A | 8829 | 8844 | GCTTTAAACTCAGGTG | kk-d9-eeekk | 91 | 81 |
| 969318 | N/A | N/A | 6701 | 6716 | TATTTCTTGATGTGGT | kk-d9-eeekk | 99 | 1904 |
| 969328 | N/A | N/A | 8828 | 8843 | CTTTAAACTCAGGTGA | kk-d9-eeekk | 92 | 151 |
| 969338 | N/A | N/A | 5412 | 5427 | ATTCTCATGGTACAGG | kk-d9-eeekk | 92 | 677 |
| 969348 | N/A | N/A | 8321 | 8336 | GTTATGAAATTATTGG | kk-d9-eeekk | 54 | 76 |
| 969358 | 2252 | 2267 | 14343 | 14358 | CCGTCAATATATTCTT | kk-d9-eeekk | 98 | 1936 |
| 969368 | N/A | N/A | 8165 | 8180 | GCATTCAGAATTTCCA | kk-d9-eeekk | 98 | 1937 |
| 969378 | 972 | 987 | 13063 | 13078 | GTAAGTATTGCCAGCT | kk-d9-eeekk | 89 | 1933 |
| 969388 | N/A | N/A | 6704 | 6719 | GTGTATTTCTTGATGT | kk-d9-eeekk | 96 | 1940 |
| 969398 | N/A | N/A | 8829 | 8844 | GCTTTAAACTCAGGTG | kk-d9-ekeke | 92 | 81 |
| 969408 | N/A | N/A | 6701 | 6716 | TATTTCTTGATGTGGT | kk-d9-ekeke | 99 | 1904 |
| 969418 | N/A | N/A | 8828 | 8843 | CTTTAAACTCAGGTGA | kk-d9-ekeke | 91 | 151 |
| 969428 | N/A | N/A | 5412 | 5427 | ATTCTCATGGTACAGG | kk-d9-ekeke | 95 | 677 |
| 969438 | N/A | N/A | 8321 | 8336 | GTTATGAAATTATTGG | kk-d9-ekeke | 68 | 76 |
| 969448 | 2253 | 2268 | 14344 | 14359 | TCCGTCAATATATTCT | kk-d9-ekeke | 97 | 1897 |
| 969458 | N/A | N/A | 6820 | 6835 | GAACGCAATGCTGACT | kk-d9-ekeke | 95 | 1888 |
| 969478 | N/A | N/A | 6547 | 6562 | TCAGATGGGTACTTCT | kk-d9-kdkdk | 88 | 411 |
| 969488 | N/A | N/A | 8743 | 8758 | TTCTATTAGAGGGCTA | kk-d9-kdkdk | 87 | 80 |
| 969498 | 2736 | 2751 | 14827 | 14842 | GCTAATTTTCTGACTG | kk-d9-kdkdk | 93 | 1283 |
| 969508 | N/A | N/A | 8237 | 8252 | GAGTATTGTTTTGTG | kk-d9-kdkdk | 92 | 1899 |
| 971918 | 2735 | 2750 | 14826 | 14841 | CTAATTTTCTGACTGT | kk-d9-kekek | 83 | 1901 |
| 971928 | N/A | N/A | 8163 | 8178 | ATTCAGAATTTCCACT | kk-d9-kekek | 76 | 1902 |
| 971938 | N/A | N/A | 8832 | 8847 | GAAGCTTTAAACTCAG | kk-d9-kekek | 84 | 1397 |
| 971948 | N/A | N/A | 5856 | 5871 | GTTTTGTAAGTGCAAC | kk-d9-kekek | 88 | 1230 |

TABLE 33-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 971958 | N/A | N/A | 8368 | 8383 | CACTTTATACCAGTGT | kk-d9-kekek | 14 | 1908 |
| 971968 | 2340 | 2355 | 14431 | 14446 | GTTCTAACTCTTGGGC | kk-d9-kekek | 61 | 243 |
| 971978 | N/A | N/A | 8164 | 8179 | CATTCAGAATTTCCAC | kk-d9-kekek | 76 | 1730 |
| 971998 | N/A | N/A | 5412 | 5427 | ATTCTCATGGTACAGG | kkk-d8-kdkdk | 81 | 677 |
| 972008 | N/A | N/A | 8237 | 8252 | GAGTATTGTTTTGTG | kkk-d8-kdkdk | 54 | 1899 |
| 972018 | 969 | 984 | 13060 | 13075 | AGTATTGCCAGCTAAG | kkk-d8-kekek | 66 | 1479 |
| 972028 | N/A | N/A | 6817 | 6832 | CGCAATGCTGACTTGG | kkk-d8-kekek | 68 | 1924 |
| 972048 | N/A | N/A | 5451 | 5466 | GTGTTATATTTGATCC | kkk-d8-kekek | 75 | 1934 |
| 972058 | N/A | N/A | 8323 | 8338 | GGGTTATGAAATTATT | kkk-d8-kekek | 73 | 1935 |
| 972068 | 1033 | 1048 | 13124 | 13139 | GAAGATTGGCTCTGGC | kkk-d8-kekek | 16 | 1480 |
| 972078 | N/A | N/A | 6818 | 6833 | ACGCAATGCTGACTTG | kkk-d8-kekek | 71 | 1905 |
| 972088 | N/A | N/A | 8831 | 8846 | AAGCTTTAAACTCAGG | kkk-d9-keke | 84 | 1327 |
| 972098 | N/A | N/A | 5859 | 5874 | GCAGTTTTGTAAGTGC | kkk-d9-keke | 60 | 1647 |
| 972108 | N/A | N/A | 8744 | 8759 | ATTCTATTAGAGGGCT | kkk-d9-keke | 73 | 1326 |
| 972118 | 2736 | 2751 | 14827 | 14842 | GCTAATTTTCTGACTG | kkk-d9-keke | 93 | 1283 |
| 972128 | N/A | N/A | 8237 | 8252 | GAGTATTGTTTTGTG | kkk-d9-keke | 81 | 1899 |
| 972138 | 1032 | 1047 | 13123 | 13138 | AAGATTGGCTCTGGCT | kkk-d9-kkke | 35 | 1411 |
| 972148 | N/A | N/A | 7921 | 7936 | GAATTATGGAATTGCA | kkk-d9-kkke | 90 | 1183 |
| 972168 | N/A | N/A | 5854 | 5869 | TTTGTAAGTGCAACCA | kkk-d9-kkke | 56 | 1095 |
| 972178 | N/A | N/A | 8366 | 8381 | CTTTATACCAGTGTCT | kkk-d9-kkke | 95 | 1890 |
| 972188 | N/A | N/A | 5413 | 5428 | TATTCTCATGGTACAG | kkk-d9-kkke | 79 | 1915 |
| 972198 | N/A | N/A | 8322 | 8337 | GGTTATGAAATTATTG | kkk-d9-kkke | 91 | 1930 |

TABLE 34

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 904627 | N/A | N/A | 5449 | 5464 | GTTATATTTGATCCTC | kkk-d10-kkk | 100 | 1900 |
| 905095 | N/A | N/A | 6702 | 6717 | GTATTTCTTGATGTGG | kkk-d10-kkk | 100 | 413 |
| 905491 | N/A | N/A | 8237 | 8252 | GAGTATTGTTTTGTG | kkk-d10-kkk | 94 | 1899 |
| 969059 | N/A | N/A | 5447 | 5462 | TATATTTGATCCTCAA | k-d10-kekek | 89 | 1932 |
| 969069 | N/A | N/A | 8331 | 8346 | ACATCATTGGGTTATG | k-d10-kekek | 89 | 286 |
| 969079 | 1033 | 1048 | 13124 | 13139 | GAAGATTGGCTCTGGC | k-d10-kekek | 44 | 1480 |
| 969089 | N/A | N/A | 6702 | 6717 | GTATTTCTTGATGTGG | k-d10-kekek | 92 | 413 |
| 969099 | N/A | N/A | 8829 | 8844 | GCTTTAAACTCAGGTG | k-d10-kekek | 92 | 81 |

TABLE 34-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969109 | N/A | N/A | 5856 | 5871 | GTTTTGTAAGTGCAAC | k-d9-kekeke | 73 | 1230 |
| 969119 | N/A | N/A | 8742 | 8757 | TCTATTAGAGGGCTAG | k-d9-kekeke | 37 | 150 |
| 969129 | 2736 | 2751 | 14827 | 14842 | GCTAATTTTCTGACTG | k-d9-kekeke | 88 | 1283 |
| 969139 | N/A | N/A | 8164 | 8179 | CATTCAGAATTTCCAC | k-d9-kekeke | 58 | 1730 |
| 969149 | N/A | N/A | 8830 | 8845 | AGCTTTAAACTCAGGT | kek-d9-eekk | 82 | 1920 |
| 969159 | N/A | N/A | 5854 | 5869 | TTTGTAAGTGCAACCA | kek-d9-eekk | 99 | 1095 |
| 969169 | N/A | N/A | 8366 | 8381 | CTTTATACCAGTGTCT | kek-d9-eekk | 95 | 1890 |
| 969179 | N/A | N/A | 5411 | 5426 | TTCTCATGGTACAGGA | kk-d10-keke | 78 | 607 |
| 969189 | N/A | N/A | 8236 | 8251 | AGTATTGTTTTGTGG | kk-d10-keke | 91 | 1922 |
| 969199 | N/A | N/A | 8306 | 8321 | GTTCAAAAGCAGCATT | kk-d10-keke | 89 | 13 |
| 969209 | N/A | N/A | 6548 | 6563 | ATCAGATGGGTACTTC | kk-d10-keke | 83 | 481 |
| 969229 | N/A | N/A | 5857 | 5872 | AGTTTTGTAAGTGCAA | kk-d8-eeekk | 94 | 1917 |
| 969239 | N/A | N/A | 8742 | 8757 | TCTATTAGAGGGCTAG | kk-d8-eeekk | 44 | 150 |
| 969249 | N/A | N/A | 5448 | 5463 | TTATATTTGATCCTCA | kk-d8-kekekk | 69 | 1909 |
| 969259 | N/A | N/A | 8364 | 8379 | TTATACCAGTGTCTTC | kk-d8-kekekk | 68 | 1938 |
| 969269 | N/A | N/A | 5411 | 5426 | TTCTCATGGTACAGGA | kk-d8-kekekk | 20 | 607 |
| 969279 | N/A | N/A | 8320 | 8335 | TTATGAAATTATTGGT | kk-d8-kekekk | 63 | 1910 |
| 969289 | 2251 | 2266 | 14342 | 14357 | CGTCAATATATTCTTT | kk-d8-kekekk | 95 | 1925 |
| 969299 | N/A | N/A | 7922 | 7937 | GGAATTATGGAATTGC | kk-d8-kekekk | 74 | 1249 |
| 969309 | 969 | 984 | 13060 | 13075 | AGTATTGCCAGCTAAG | kk-d9-eekk | 86 | 1479 |
| 969319 | N/A | N/A | 6817 | 6832 | CGCAATGCTGACTTGG | kk-d9-eekk | 88 | 1924 |
| 969339 | N/A | N/A | 5450 | 5465 | TGTTATATTTGATCCT | kk-d9-eekk | 87 | 1887 |
| 969349 | N/A | N/A | 8333 | 8348 | ACACATCATTGGGTTA | kk-d9-eekk | 51 | 426 |
| 969359 | 2341 | 2356 | 14432 | 14447 | TGTTCTAACTCTTGGG | kk-d9-eekk | 97 | 313 |
| 969369 | N/A | N/A | 8238 | 8253 | TGAGTATTGTTTTTGT | kk-d9-eekk | 87 | 1916 |
| 969379 | 1035 | 1050 | 13126 | 13141 | CTGAAGATTGGCTCTG | kk-d9-eekk | 54 | 1939 |
| 969389 | N/A | N/A | 6820 | 6835 | GAACGCAATGCTGACT | kk-d9-eekk | 95 | 1888 |
| 969399 | 969 | 984 | 13060 | 13075 | AGTATTGCCAGCTAAG | kk-d9-ekeke | 78 | 1479 |
| 969409 | N/A | N/A | 6817 | 6832 | CGCAATGCTGACTTGG | kk-d9-ekeke | 94 | 1924 |
| 969429 | N/A | N/A | 5450 | 5465 | TGTTATATTTGATCCT | kk-d9-ekeke | 94 | 1887 |
| 969439 | N/A | N/A | 8333 | 8348 | ACACATCATTGGGTTA | kk-d9-ekeke | 64 | 426 |
| 969449 | 2342 | 2357 | 14433 | 14448 | CTGTTCTAACTCTTGG | kk-d9-ekeke | 97 | 383 |
| 969459 | N/A | N/A | 7924 | 7939 | TGGGAATTATGGAATT | kk-d9-ekeke | 78 | 1929 |
| 969469 | N/A | N/A | 8829 | 8844 | GCTTTAAACTCAGGTG | kk-d9-kdkdk | 96 | 81 |
| 969479 | N/A | N/A | 6701 | 6716 | TATTTCTTGATGTGGT | kk-d9-kdkdk | 97 | 1904 |
| 969489 | N/A | N/A | 8828 | 8843 | CTTTAAACTCAGGTGA | kk-d9-kdkdk | 89 | 151 |
| 969499 | N/A | N/A | 5412 | 5427 | ATTCTCATGGTACAGG | kk-d9-kdkdk | 84 | 677 |

TABLE 34-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969509 | N/A | N/A | 8321 | 8336 | GTTATGAAATTATTGG | kk-d9-kdkdk | 71 | 76 |
| 971919 | N/A | N/A | 5411 | 5426 | TTCTCATGGTACAGGA | kk-d9-kekek | 76 | 607 |
| 971929 | N/A | N/A | 8236 | 8251 | AGTATTGTTTTTGTGG | kk-d9-kekek | 75 | 1922 |
| 971939 | N/A | N/A | 8308 | 8323 | TGGTTCAAAAGCAGCA | kk-d9-kekek | 68 | 1048 |
| 971949 | N/A | N/A | 5860 | 5875 | GGCAGTTTTGTAAGTG | kk-d9-kekek | 65 | 123 |
| 971959 | N/A | N/A | 8745 | 8760 | AATTCTATTAGAGGGC | kk-d9-kekek | 56 | 1396 |
| 971969 | 2736 | 2751 | 14827 | 14842 | GCTAATTTTCTGACTG | kk-d9-kekek | 96 | 1283 |
| 971979 | N/A | N/A | 8237 | 8252 | GAGTATTGTTTTTGTG | kk-d9-kekek | 90 | 1899 |
| 971999 | N/A | N/A | 5449 | 5464 | GTTATATTTGATCCTC | kkk-d8-kdkdk | 92 | 1900 |
| 972009 | N/A | N/A | 8321 | 8336 | GTTATGAAATTATTGG | kkk-d8-kdkdk | 91 | 76 |
| 972019 | 1032 | 1047 | 13123 | 13138 | AAGATTGGCTCTGGCT | kkk-d8-kekek | 23 | 1411 |
| 972029 | N/A | N/A | 7921 | 7936 | GAATTATGGAATTGCA | kkk-d8-kekek | 61 | 1183 |
| 972049 | N/A | N/A | 5452 | 5467 | CGTGTTATATTTGATC | kkk-d8-kekek | 82 | 1906 |
| 972059 | N/A | N/A | 8335 | 8350 | CAACACATCATTGGGT | kkk-d8-kekek | 30 | 1907 |
| 972069 | 2251 | 2266 | 14342 | 14357 | CGTCAATATATTCTTT | kkk-d8-kekek | 94 | 1925 |
| 972079 | N/A | N/A | 7922 | 7937 | GGAATTATGGAATTGC | kkk-d8-kekek | 66 | 1249 |
| 972089 | N/A | N/A | 8307 | 8322 | GGTTCAAAAGCAGCAT | kkk-d9-keke | 70 | 978 |
| 972099 | N/A | N/A | 6549 | 6564 | TATCAGATGGGTACTT | kkk-d9-keke | 37 | 550 |
| 972109 | N/A | N/A | 8745 | 8760 | AATTCTATTAGAGGGC | kkk-d9-keke | 82 | 1396 |
| 972119 | N/A | N/A | 5412 | 5427 | ATTCTCATGGTACAGG | kkk-d9-keke | 94 | 677 |
| 972129 | N/A | N/A | 8321 | 8336 | GTTATGAAATTATTGG | kkk-d9-keke | 93 | 76 |
| 972139 | 2735 | 2750 | 14826 | 14841 | CTAATTTTCTGACTGT | kkk-d9-kkke | 99 | 1901 |
| 972149 | N/A | N/A | 8163 | 8178 | ATTCAGAATTTCCACT | kkk-d9-kkke | 89 | 1902 |
| 972159 | N/A | N/A | 8830 | 8845 | AGCTTTAAACTCAGGT | kkk-d9-kkke | 82 | 1920 |
| 972169 | N/A | N/A | 5858 | 5873 | CAGTTTTGTAAGTGCA | kkk-d9-kkke | 92 | 1577 |
| 972179 | N/A | N/A | 8744 | 8759 | ATTCTATTAGAGGGCT | kkk-d9-kkke | 85 | 1326 |
| 972189 | N/A | N/A | 5451 | 5466 | GTGTTATATTTGATCC | kkk-d9-kdke | 94 | 1934 |
| 972199 | N/A | N/A | 8334 | 8349 | AACACATCATTGGGTT | kkk-d9-kkke | 58 | 496 |

TABLE 35

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 904763 | N/A | N/A | 5854 | 5869 | TTTGTAAGTGCAACCA | kkk-d10-kkk | 98 | 1095 |
| 905095 | N/A | N/A | 6702 | 6717 | GTATTCTTGATGTGG | kkk-d10-kkk | 100 | 413 |

TABLE 35-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 905491 | N/A | N/A | 8237 | 8252 | GAGTATTGTTTTTGTG | kkk-d10-kkk | 94 | 1899 |
| 969060 | N/A | N/A | 5448 | 5463 | TTATATTTGATCCTCA | k-d10-kekek | 82 | 1909 |
| 969070 | N/A | N/A | 8364 | 8379 | TTATACCAGTGTCTTC | k-d10-kekek | 82 | 1938 |
| 969080 | 2251 | 2266 | 14342 | 14357 | CGTCAATATATTCTTT | k-d10-kekek | 90 | 1925 |
| 969090 | N/A | N/A | 6818 | 6833 | ACGCAATGCTGACTTG | k-d10-kekek | 71 | 1905 |
| 969110 | N/A | N/A | 6546 | 6561 | CAGATGGGTACTTCTG | k-d9-kekeke | 23 | 341 |
| 969120 | N/A | N/A | 8827 | 8842 | TTTAAACTCAGGTGAC | k-d9-kekeke | 43 | 1675 |
| 969130 | N/A | N/A | 5412 | 5427 | ATTCTCATGGTACAGG | k-d9-kekeke | 51 | 677 |
| 969140 | N/A | N/A | 8237 | 8252 | GAGTATTGTTTTTGTG | k-d9-kekeke | 94 | 1899 |
| 969150 | N/A | N/A | 8306 | 8321 | GTTCAAAAGCAGCATT | kek-d9-eekk | 89 | 13 |
| 969160 | N/A | N/A | 5858 | 5873 | CAGTTTTGTAAGTGCA | kek-d9-eekk | 96 | 1577 |
| 969170 | N/A | N/A | 8743 | 8758 | TTCTATTAGAGGGCTA | kek-d9-eekk | 94 | 80 |
| 969180 | N/A | N/A | 5448 | 5463 | TTATATTTGATCCTCA | kk-d10-keke | 96 | 1909 |
| 969190 | N/A | N/A | 8320 | 8335 | TTATGAAATTATTGGT | kk-d10-keke | 63 | 1910 |
| 969200 | 970 | 985 | 13061 | 13076 | AAGTATTGCCAGCTAA | kk-d10-keke | 73 | 1911 |
| 969210 | N/A | N/A | 6702 | 6717 | GTATTTCTTGATGTGG | kk-d10-keke | 98 | 413 |
| 969230 | N/A | N/A | 6547 | 6562 | TCAGATGGGTACTTCT | kk-d8-eeeekk | 78 | 411 |
| 969240 | N/A | N/A | 8743 | 8758 | TTCTATTAGAGGGCTA | kk-d8-eeeekk | 76 | 80 |
| 969250 | N/A | N/A | 5852 | 5867 | TGTAAGTGCAACCAAT | kk-d8-kekekk | 43 | 955 |
| 969260 | N/A | N/A | 8741 | 8756 | CTATTAGAGGGCTAGT | kk-d8-kekekk | 25 | 1674 |
| 969270 | N/A | N/A | 5449 | 5464 | GTTATATTTGATCCTC | kk-d8-kekekk | 43 | 1900 |
| 969280 | N/A | N/A | 8332 | 8347 | CACATCATTGGGTTAT | kk-d8-kekekk | 34 | 356 |
| 969290 | 2340 | 2355 | 14431 | 14446 | GTTCTAACTCTTGGGC | kk-d8-kekekk | 52 | 243 |
| 969300 | N/A | N/A | 8164 | 8179 | CATTCAGAATTTCCAC | kk-d8-kekekk | 57 | 1730 |
| 969310 | 1032 | 1047 | 13123 | 13138 | AAGATTGGCTCTGGCT | kk-d9-eeekk | 63 | 1411 |
| 969320 | N/A | N/A | 7921 | 7936 | GAATTATGGAATTGCA | kk-d9-eeekk | 94 | 1183 |
| 969340 | N/A | N/A | 5854 | 5869 | TTTGTAAGTGCAACCA | kk-d9-eeekk | 99 | 1095 |
| 969350 | N/A | N/A | 8366 | 8381 | CTTTATACCAGTGTCT | kk-d9-eeekk | 96 | 1890 |
| 969360 | N/A | N/A | 5413 | 5428 | TATTCTCATGGTACAG | kk-d9-eeekk | 71 | 1915 |
| 969370 | N/A | N/A | 8322 | 8337 | GGTTATGAAATTATTG | kk-d9-eeekk | 61 | 1930 |
| 969380 | 2253 | 2268 | 14344 | 14359 | TCCGTCAATATATTCT | kk-d9-eeekk | 96 | 1897 |
| 969390 | N/A | N/A | 7924 | 7939 | TGGGAATTATGGAATT | kk-d9-eeekk | 63 | 1929 |
| 969400 | 1032 | 1047 | 13123 | 13138 | AAGATTGGCTCTGGCT | kk-d9-ekeke | 66 | 1411 |
| 969410 | N/A | N/A | 7921 | 7936 | GAATTATGGAATTGCA | kk-d9-ekeke | 95 | 1183 |
| 969430 | N/A | N/A | 5854 | 5869 | TTTGTAAGTGCAACCA | kk-d9-ekeke | 97 | 1095 |
| 969440 | N/A | N/A | 8366 | 8381 | CTTTATACCAGTGTCT | kk-d9-ekeke | 98 | 1890 |
| 969450 | 2738 | 2753 | 14829 | 14844 | ATGCTAATTTTCTGAC | kk-d9-ekeke | 95 | 1912 |

TABLE 35-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969460 | N/A | N/A | 8166 | 8181 | GGCATTCAGAATTTCC | kk-d9-ekeke | 93 | 1913 |
| 969470 | 969 | 984 | 13060 | 13075 | AGTATTGCCAGCTAAG | kk-d9-kdkdk | 69 | 1479 |
| 969480 | N/A | N/A | 6817 | 6832 | CGCAATGCTGACTTGG | kk-d9-kdkdk | 94 | 1924 |
| 969500 | N/A | N/A | 5450 | 5465 | TGTTATATTTGATCCT | kk-d9-kdkdk | 86 | 1887 |
| 969510 | N/A | N/A | 8333 | 8348 | ACACATCATTGGGTTA | kk-d9-kdkdk | 57 | 426 |
| 971920 | N/A | N/A | 5448 | 5463 | TTATATTTGATCCTCA | kk-d9-kekek | 91 | 1909 |
| 971930 | N/A | N/A | 8320 | 8335 | TTATGAAATTATTGGT | kk-d9-kekek | 82 | 1910 |
| 971940 | 972 | 987 | 13063 | 13078 | GTAAGTATTGCCAGCT | kk-d9-kekek | 53 | 1933 |
| 971950 | N/A | N/A | 6550 | 6565 | ATATCAGATGGGTACT | kk-d9-kekek | 21 | 620 |
| 971960 | N/A | N/A | 8746 | 8761 | TAATTCTATTAGAGGG | kk-d9-kekek | 34 | 220 |
| 971970 | N/A | N/A | 5412 | 5427 | ATTCTCATGGTACAGG | kk-d9-kekek | 76 | 677 |
| 971980 | N/A | N/A | 8321 | 8336 | GTTATGAAATTATTGG | kk-d9-kekek | 83 | 76 |
| 972000 | N/A | N/A | 5450 | 5465 | TGTTATATTTGATCCT | kkk-d8-kdkdk | 66 | 1887 |
| 972010 | N/A | N/A | 8333 | 8348 | ACACATCATTGGGTTA | kkk-d8-kdkdk | 48 | 426 |
| 972020 | 2735 | 2750 | 14826 | 14841 | CTAATTTTCTGACTGT | kkk-d8-kekek | 90 | 1901 |
| 972030 | N/A | N/A | 8163 | 8178 | ATTCAGAATTTCCACT | kkk-d8-kekek | 56 | 1902 |
| 972040 | N/A | N/A | 8832 | 8847 | GAAGCTTTAAACTCAG | kkk-d8-kekek | 47 | 1397 |
| 972050 | N/A | N/A | 5856 | 5871 | GTTTTGTAAGTGCAAC | kkk-d8-kekek | 59 | 1230 |
| 972060 | N/A | N/A | 8368 | 8383 | CACTTTATACCAGTGT | kkk-d8-kekek | 11 | 1908 |
| 972070 | 2340 | 2355 | 14431 | 14446 | GTTCTAACTCTTGGGC | kkk-d8-kekek | 37 | 243 |
| 972080 | N/A | N/A | 8164 | 8179 | CATTCAGAATTTCCAC | kkk-d8-kekek | 65 | 1730 |
| 972090 | 971 | 986 | 13062 | 13077 | TAAGTATTGCCAGCTA | kkk-d9-keke | 78 | 1918 |
| 972100 | N/A | N/A | 6703 | 6718 | TGTATTTCTTGATGTG | kkk-d9-keke | 71 | 1926 |
| 972110 | N/A | N/A | 8830 | 8845 | AGCTTTAAACTCAGGT | kkk-d9-keke | 85 | 1920 |
| 972120 | N/A | N/A | 5449 | 5464 | GTTATATTTGATCCTC | kkk-d9-keke | 98 | 1900 |
| 972130 | N/A | N/A | 8333 | 8348 | ACACATCATTGGGTTA | kkk-d9-keke | 58 | 426 |
| 972140 | N/A | N/A | 5411 | 5426 | TTCTCATGGTACAGGA | kkk-d9-kkke | 44 | 607 |
| 972150 | N/A | N/A | 8236 | 8251 | AGTATTGTTTTGTGG | kkk-d9-kkke | 89 | 1922 |
| 972160 | N/A | N/A | 8306 | 8321 | GTTCAAAAGCAGCATT | kkk-d9-kkke | 80 | 13 |
| 972170 | N/A | N/A | 6548 | 6563 | ATCAGATGGGTACTTC | kkk-d9-kkke | 88 | 481 |
| 972190 | N/A | N/A | 5855 | 5870 | TTTTGTAAGTGCAACC | kkk-d9-kkke | 98 | 1164 |
| 972200 | N/A | N/A | 8367 | 8382 | ACTTTATACCAGTGTC | kkk-d9-kkke | 58 | 1941 |

TABLE 36

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 904766 | N/A | N/A | 5858 | 5873 | CAGTTTTGTAAGTGCA | kkk-d10-kkk | 97 | 1577 |
| 905095 | N/A | N/A | 6702 | 6717 | GTATTTCTTGATGTGG | kkk-d10-kkk | 99 | 413 |
| 905491 | N/A | N/A | 8237 | 8252 | GAGTATTGTTTTGTG | kkk-d10-kkk | 93 | 1899 |
| 969061 | N/A | N/A | 5852 | 5867 | TGTAAGTGCAACCAAT | k-d10-kekek | 81 | 955 |
| 969071 | N/A | N/A | 8741 | 8756 | CTATTAGAGGGCTAGT | k-d10-kekek | 28 | 1674 |
| 969081 | 2340 | 2355 | 14431 | 14446 | GTTCTAACTCTTGGGC | k-d10-kekek | 28 | 243 |
| 969091 | N/A | N/A | 7922 | 7937 | GGAATTATGGAATTGC | k-d10-kekek | 92 | 1249 |
| 969111 | N/A | N/A | 6700 | 6715 | ATTTCTTGATGTGGTG | k-d9-kekeke | 81 | 343 |
| 969131 | N/A | N/A | 5449 | 5464 | GTTATATTTGATCCTC | k-d9-kekeke | 60 | 1900 |
| 969141 | N/A | N/A | 8321 | 8336 | GTTATGAAATTATTGG | k-d9-kekeke | 77 | 76 |
| 969151 | 970 | 985 | 13061 | 13076 | AAGTATTGCCAGCTAA | kek-d9-eekk | 88 | 1911 |
| 969161 | N/A | N/A | 6548 | 6563 | ATCAGATGGGTACTTC | kek-d9-eekk | 91 | 481 |
| 969171 | N/A | N/A | 8744 | 8759 | ATTCTATTAGAGGGCT | kek-d9-eekk | 77 | 1326 |
| 969181 | N/A | N/A | 5449 | 5464 | GTTATATTTGATCCTC | kk-d10-keke | 97 | 1900 |
| 969191 | N/A | N/A | 8332 | 8347 | CACATCATTGGGTTAT | kk-d10-keke | 77 | 356 |
| 969201 | 1033 | 1048 | 13124 | 13139 | GAAGATTGGCTCTGGC | kk-d10-keke | 70 | 1480 |
| 969211 | N/A | N/A | 6818 | 6833 | ACGCAATGCTGACTTG | kk-d10-keke | 89 | 1905 |
| 969221 | N/A | N/A | 8829 | 8844 | GCTTTAAACTCAGGTG | kk-d8-eeeekk | 95 | 81 |
| 969231 | N/A | N/A | 6701 | 6716 | TATTTCTTGATGTGGT | kk-d8-eeeekk | 96 | 1904 |
| 969241 | N/A | N/A | 8828 | 8843 | CTTTAAACTCAGGTGA | kk-d8-eeeekk | 88 | 151 |
| 969251 | N/A | N/A | 5856 | 5871 | GTTTTGTAAGTGCAAC | kk-d8-kekekk | 62 | 1230 |
| 969261 | N/A | N/A | 8742 | 8757 | TCTATTAGAGGGCTAG | kk-d8-kekekk | 25 | 150 |
| 969271 | N/A | N/A | 5853 | 5868 | TTGTAAGTGCAACCAA | kk-d8-kekekk | 54 | 1025 |
| 969281 | N/A | N/A | 8365 | 8380 | TTTATACCAGTGTCTT | kk-d8-kekekk | 51 | 1914 |
| 969291 | 2736 | 2751 | 14827 | 14842 | GCTAATTTTCTGACTG | kk-d8-kekekk | 71 | 1283 |
| 969301 | N/A | N/A | 8237 | 8252 | GAGTATTGTTTTGTG | kk-d8-kekekk | 85 | 1899 |
| 969311 | 2735 | 2750 | 14826 | 14841 | CTAATTTTCTGACTGT | kk-d9-eeekk | 83 | 1901 |
| 969321 | N/A | N/A | 8163 | 8178 | ATTCAGAATTTCCACT | kk-d9-eeekk | 77 | 1902 |
| 969331 | N/A | N/A | 8830 | 8845 | AGCTTTAAACTCAGGT | kk-d9-eeekk | 93 | 1920 |
| 969341 | N/A | N/A | 5858 | 5873 | CAGTTTTGTAAGTGCA | kk-d9-eeekk | 92 | 1577 |
| 969351 | N/A | N/A | 8744 | 8759 | ATTCTATTAGAGGGCT | kk-d9-eeekk | 70 | 1326 |
| 969361 | N/A | N/A | 5451 | 5466 | GTGTTATATTTGATCC | kk-d9-eeekk | 98 | 1934 |
| 969371 | N/A | N/A | 8334 | 8349 | AACACATCATTGGGTT | kk-d9-eeekk | 43 | 496 |
| 969381 | 2342 | 2357 | 14433 | 14448 | CTGTTCTAACTCTTGG | kk-d9-eeekk | 93 | 383 |
| 969391 | N/A | N/A | 8166 | 8181 | GGCATTCAGAATTTCC | kk-d9-eeekk | 97 | 1913 |
| 969401 | 2735 | 2750 | 14826 | 14841 | CTAATTTTCTGACTGT | kk-d9-ekeke | 90 | 1901 |
| 969411 | N/A | N/A | 8163 | 8178 | ATTCAGAATTTCCACT | kk-d9-ekeke | 87 | 1902 |

TABLE 36-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969421 | N/A | N/A | 8830 | 8845 | AGCTTTAAACTCAGGT | kk-d9-ekeke | 92 | 1920 |
| 969431 | N/A | N/A | 5858 | 5873 | CAGTTTTGTAAGTGCA | kk-d9-ekeke | 91 | 1577 |
| 969441 | N/A | N/A | 8744 | 8759 | ATTCTATTAGAGGGCT | kk-d9-ekeke | 25 | 1326 |
| 969451 | N/A | N/A | 5414 | 5429 | TTATTCTCATGGTACA | kk-d9-ekeke | 51 | 1927 |
| 969461 | N/A | N/A | 8239 | 8254 | GTGAGTATTGTTTTG | kk-d9-ekeke | 93 | 1928 |
| 969471 | 1032 | 1047 | 13123 | 13138 | AAGATTGGCTCTGGCT | kk-d9-kdkdk | 65 | 1411 |
| 969481 | N/A | N/A | 7921 | 7936 | GAATTATGGAATTGCA | kk-d9-kdkdk | 82 | 1183 |
| 969501 | N/A | N/A | 5854 | 5869 | TTTGTAAGTGCAACCA | kk-d9-kdkdk | 99 | 1095 |
| 969511 | N/A | N/A | 8366 | 8381 | CTTTATACCAGTGTCT | kk-d9-kdkdk | 92 | 1890 |
| 971921 | N/A | N/A | 5449 | 5464 | GTTATATTTGATCCTC | kk-d9-kekek | 80 | 1900 |
| 971931 | N/A | N/A | 8332 | 8347 | CACATCATTGGGTTAT | kk-d9-kekek | 74 | 356 |
| 971941 | 1035 | 1050 | 13126 | 13141 | CTGAAGATTGGCTCTG | kk-d9-kekek | 45 | 1939 |
| 971951 | N/A | N/A | 6704 | 6719 | GTGTATTTCTTGATGT | kk-d9-kekek | 95 | 1940 |
| 971961 | N/A | N/A | 8831 | 8846 | AAGCTTTAAACTCAGG | kk-d9-kekek | 48 | 1327 |
| 971971 | N/A | N/A | 5450 | 5465 | TGTTATATTTGATCCT | kk-d9-kekek | 81 | 1887 |
| 971981 | N/A | N/A | 8333 | 8348 | ACACATCATTGGGTTA | kk-d9-kekek | 50 | 426 |
| 971991 | N/A | N/A | 8830 | 8845 | AGCTTTAAACTCAGGT | kkk-d8-kdkdk | 74 | 1920 |
| 972001 | N/A | N/A | 5854 | 5869 | TTTGTAAGTGCAACCA | kkk-d8-kdkdk | 71 | 1095 |
| 972011 | N/A | N/A | 8366 | 8381 | CTTTATACCAGTGTCT | kkk-d8-kdkdk | 87 | 1890 |
| 972021 | N/A | N/A | 5411 | 5426 | TTCTCATGGTACAGGA | kkk-d8-kekek | 54 | 607 |
| 972031 | N/A | N/A | 8236 | 8251 | AGTATTGTTTTTGTGG | kkk-d8-kekek | 55 | 1922 |
| 972041 | N/A | N/A | 8308 | 8323 | TGGTTCAAAAGCAGCA | kkk-d8-kekek | 57 | 1048 |
| 972051 | N/A | N/A | 5860 | 5875 | GGCAGTTTTGTAAGTG | kkk-d8-kekek | 32 | 123 |
| 972061 | N/A | N/A | 8745 | 8760 | AATTCTATTAGAGGGC | kkk-d8-kekek | 41 | 1396 |
| 972071 | 2736 | 2751 | 14827 | 14842 | GCTAATTTTCTGACTG | kkk-d8-kekek | 88 | 1283 |
| 972081 | N/A | N/A | 8237 | 8252 | GAGTATTGTTTTTGTG | kkk-d8-kekek | 56 | 1899 |
| 972091 | 1034 | 1049 | 13125 | 13140 | TGAAGATTGGCTCTGG | kkk-d9-keke | 54 | 1931 |
| 972101 | N/A | N/A | 6819 | 6834 | AACGCAATGCTGACTT | kkk-d9-keke | 83 | 1919 |
| 972121 | N/A | N/A | 5854 | 5869 | TTTGTAAGTGCAACCA | kkk-d9-keke | 49 | 1095 |
| 972131 | N/A | N/A | 8366 | 8381 | CTTTATACCAGTGTCT | kkk-d9-keke | 94 | 1890 |
| 972141 | N/A | N/A | 5448 | 5463 | TTATATTTGATCCTCA | kkk-d9-kkke | 96 | 1909 |
| 972151 | N/A | N/A | 8320 | 8335 | TTATGAAATTATTGGT | kkk-d9-kkke | 85 | 1910 |
| 972161 | 970 | 985 | 13061 | 13076 | AAGTATTGCCAGCTAA | kkk-d9-kkke | 49 | 1911 |
| 972171 | N/A | N/A | 6702 | 6717 | GTATTTCTTGATGTGG | kkk-d9-kkke | 98 | 413 |
| 972191 | N/A | N/A | 5859 | 5874 | GCAGTTTTGTAAGTGC | kkk-d9-kkke | 76 | 1647 |
| 972201 | N/A | N/A | 8745 | 8760 | AATTCTATTAGAGGGC | kkk-d9-kkke | 70 | 1396 |

TABLE 37

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 905095 | N/A | N/A | 6702 | 6717 | GTATTTCTTGATGTGG | kkk-d10-kkk | 100 | 413 |
| 905139 | N/A | N/A | 6818 | 6833 | ACGCAATGCTGACTTG | kkk-d10-kkk | 94 | 1905 |
| 905491 | N/A | N/A | 8237 | 8252 | GAGTATTGTTTTGTG | kkk-d10-kkk | 94 | 1899 |
| 969062 | N/A | N/A | 5856 | 5871 | GTTTTGTAAGTGCAAC | k-d10-kekek | 92 | 1230 |
| 969072 | N/A | N/A | 8742 | 8757 | TCTATTAGAGGGCTAG | k-d10-kekek | 42 | 150 |
| 969082 | 2736 | 2751 | 14827 | 14842 | GCTAATTTTCTGACTG | k-d10-kekek | 98 | 1283 |
| 969092 | N/A | N/A | 8164 | 8179 | CATTCAGAATTTCCAC | k-d10-kekek | 67 | 1730 |
| 969102 | N/A | N/A | 8828 | 8843 | CTTTAAACTCAGGTGA | k-d9-kekeke | 70 | 151 |
| 969112 | N/A | N/A | 6816 | 6831 | GCAATGCTGACTTGGC | k-d9-kekeke | 45 | 1903 |
| 969132 | N/A | N/A | 5450 | 5465 | TGTTATATTTGATCCT | k-d9-kekeke | 51 | 1887 |
| 969142 | N/A | N/A | 8333 | 8348 | ACACATCATTGGGTTA | k-d9-kekeke | 36 | 426 |
| 969152 | 1033 | 1048 | 13124 | 13139 | GAAGATTGGCTCTGGC | kek-d9-eekk | 87 | 1480 |
| 969162 | N/A | N/A | 6702 | 6717 | GTATTTCTTGATGTGG | kek-d9-eekk | 99 | 413 |
| 969172 | N/A | N/A | 8829 | 8844 | GCTTTAAACTCAGGTG | kek-d9-eekk | 93 | 81 |
| 969182 | N/A | N/A | 5853 | 5868 | TTGTAAGTGCAACCAA | kk-d10-keke | 81 | 1025 |
| 969192 | N/A | N/A | 8365 | 8380 | TTTATACCAGTGTCTT | kk-d10-keke | 84 | 1914 |
| 969202 | 2251 | 2266 | 14342 | 14357 | CGTCAATATATTCTTT | kk-d10-keke | 87 | 1925 |
| 969212 | N/A | N/A | 7922 | 7937 | GGAATTATGGAATTGC | kk-d10-keke | 40 | 1249 |
| 969222 | 969 | 984 | 13060 | 13075 | AGTATTGCCAGCTAAG | kk-d8-eeeekk | 59 | 1479 |
| 969232 | N/A | N/A | 6817 | 6832 | CGCAATGCTGACTTGG | kk-d8-eeeekk | 68 | 1924 |
| 969252 | N/A | N/A | 6546 | 6561 | CAGATGGGTACTTCTG | kk-d8-kekekk | 10 | 341 |
| 969262 | N/A | N/A | 8827 | 8842 | TTTAAACTCAGGTGAC | kk-d8-kekekk | 16 | 1675 |
| 969272 | N/A | N/A | 5857 | 5872 | AGTTTTGTAAGTGCAA | kk-d8-kekekk | 84 | 1917 |
| 969282 | N/A | N/A | 8743 | 8758 | TTCTATTAGAGGGCTA | kk-d8-kekekk | 26 | 80 |
| 969292 | N/A | N/A | 5412 | 5427 | ATTCTCATGGTACAGG | kk-d8-kekekk | 34 | 677 |
| 969302 | N/A | N/A | 8321 | 8336 | GTTATGAAATTATTGG | kk-d8-kekekk | 86 | 76 |
| 969312 | N/A | N/A | 5411 | 5426 | TTCTCATGGTACAGGA | kk-d9-eeekk | 86 | 607 |
| 969322 | N/A | N/A | 8236 | 8251 | AGTATTGTTTTGTGG | kk-d9-eeekk | 90 | 1922 |
| 969332 | N/A | N/A | 8306 | 8321 | GTTCAAAAGCAGCATT | kk-d9-eeekk | 86 | 13 |
| 969342 | N/A | N/A | 6548 | 6563 | ATCAGATGGGTACTTC | kk-d9-eeekk | 67 | 481 |
| 969362 | N/A | N/A | 5855 | 5870 | TTTTGTAAGTGCAACC | kk-d9-eeekk | 99 | 1164 |
| 969372 | N/A | N/A | 8367 | 8382 | ACTTTATACCAGTGTC | kk-d9-eeekk | 91 | 1941 |
| 969382 | 2738 | 2753 | 14829 | 14844 | ATGCTAATTTTCTGAC | kk-d9-eeekk | 88 | 1912 |
| 969392 | N/A | N/A | 8239 | 8254 | GTGAGTATTGTTTTTG | kk-d9-eeekk | 92 | 1928 |
| 969402 | N/A | N/A | 5411 | 5426 | TTCTCATGGTACAGGA | kk-d9-ekeke | 79 | 607 |
| 969412 | N/A | N/A | 8236 | 8251 | AGTATTGTTTTGTGG | kk-d9-ekeke | 89 | 1922 |
| 969422 | N/A | N/A | 8306 | 8321 | GTTCAAAAGCAGCATT | kk-d9-ekeke | 82 | 13 |

TABLE 37-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969432 | N/A | N/A | 6548 | 6563 | ATCAGATGGGTACTTC | kk-d9-ekeke | 73 | 481 |
| 969452 | N/A | N/A | 5451 | 5466 | GTGTTATATTTGATCC | kk-d9-ekeke | 96 | 1934 |
| 969462 | N/A | N/A | 8323 | 8338 | GGGTTATGAAATTATT | kk-d9-ekeke | 88 | 1935 |
| 969472 | 2735 | 2750 | 14826 | 14841 | CTAATTTTCTGACTGT | kk-d9-kdkdk | 84 | 1901 |
| 969482 | N/A | N/A | 8163 | 8178 | ATTCAGAATTTCCACT | kk-d9-kdkdk | 79 | 1902 |
| 969492 | N/A | N/A | 8830 | 8845 | AGCTTTAAACTCAGGT | kk-d9-kdkdk | 86 | 1920 |
| 969502 | N/A | N/A | 5858 | 5873 | CAGTTTTGTAAGTGCA | kk-d9-kdkdk | 95 | 1577 |
| 969512 | N/A | N/A | 8744 | 8759 | ATTCTATTAGAGGGCT | kk-d9-kdkdk | 74 | 1326 |
| 971922 | N/A | N/A | 5853 | 5868 | TTGTAAGTGCAACCAA | kk-d9-kekek | 69 | 1025 |
| 971932 | N/A | N/A | 8365 | 8380 | TTTATACCAGTGTCTT | kk-d9-kekek | 89 | 1914 |
| 971942 | 2253 | 2268 | 14344 | 14359 | TCCGTCAATATATTCT | kk-d9-kekek | 94 | 1897 |
| 971952 | N/A | N/A | 6820 | 6835 | GAACGCAATGCTGACT | kk-d9-kekek | 78 | 1888 |
| 971972 | N/A | N/A | 5854 | 5869 | TTTGTAAGTGCAACCA | kk-d9-kekek | 98 | 1095 |
| 971982 | N/A | N/A | 8366 | 8381 | CTTTATACCAGTGTCT | kk-d9-kekek | 86 | 1890 |
| 971992 | N/A | N/A | 8306 | 8321 | GTTCAAAAGCAGCATT | kkk-d8-kdkdk | 23 | 13 |
| 972002 | N/A | N/A | 5858 | 5873 | CAGTTTTGTAAGTGCA | kkk-d8-kdkdk | 93 | 1577 |
| 972012 | N/A | N/A | 8743 | 8758 | TTCTATTAGAGGGCTA | kkk-d8-kdkdk | 78 | 80 |
| 972022 | N/A | N/A | 5448 | 5463 | TTATATTTGATCCTCA | kkk-d8-kekek | 92 | 1909 |
| 972032 | N/A | N/A | 8320 | 8335 | TTATGAAATTATTGGT | kkk-d8-kekek | 86 | 1910 |
| 972042 | 972 | 987 | 13063 | 13078 | GTAAGTATTGCCAGCT | kkk-d8-kekek | 73 | 1933 |
| 972052 | N/A | N/A | 6550 | 6565 | ATATCAGATGGGTACT | kkk-d8-kekek | 28 | 620 |
| 972062 | N/A | N/A | 8746 | 8761 | TAATTCTATTAGAGGG | kkk-d8-kekek | 41 | 220 |
| 972072 | N/A | N/A | 5412 | 5427 | ATTCTCATGGTACAGG | kkk-d8-kekek | 70 | 677 |
| 972082 | N/A | N/A | 8321 | 8336 | GTTATGAAATTATTGG | kkk-d8-kekek | 79 | 76 |
| 972092 | 2252 | 2267 | 14343 | 14358 | CCGTCAATATATTCTT | kkk-d9-keke | 97 | 1936 |
| 972102 | N/A | N/A | 7923 | 7938 | GGGAATTATGGAATTG | kkk-d9-keke | 63 | 1596 |
| 972122 | N/A | N/A | 5858 | 5873 | CAGTTTTGTAAGTGCA | kkk-d9-keke | 92 | 1577 |
| 972132 | N/A | N/A | 8743 | 8758 | TTCTATTAGAGGGCTA | kkk-d9-keke | 91 | 80 |
| 972142 | N/A | N/A | 5449 | 5464 | GTTATATTTGATCCTC | kkk-d9-kkke | 98 | 1900 |
| 972152 | N/A | N/A | 8332 | 8347 | CACATCATTGGGTTAT | kkk-d9-kkke | 78 | 356 |
| 972162 | 1033 | 1048 | 13124 | 13139 | GAAGATTGGCTCTGGC | kkk-d9-kkke | 70 | 1480 |
| 972172 | N/A | N/A | 6818 | 6833 | ACGCAATGCTGACTTG | kkk-d9-kkke | 88 | 1905 |
| 972182 | N/A | N/A | 8831 | 8846 | AAGCTTTAAACTCAGG | kkk-d9-kkke | 72 | 1327 |
| 972192 | N/A | N/A | 6549 | 6564 | TATCAGATGGGTACTT | kkk-d9-kkke | 69 | 550 |

TABLE 38

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 905095 | N/A | N/A | 6702 | 6717 | GTATTTCTTGATGTGG | kkk-d10-kkk | 99 | 413 |
| 905469 | N/A | N/A | 8164 | 8179 | CATTCAGAATTTCCAC | kkk-d10-kkk | 94 | 1730 |
| 905491 | N/A | N/A | 8237 | 8252 | GAGTATTGTTTTGTG | kkk-d10-kkk | 93 | 1899 |
| 969063 | N/A | N/A | 6546 | 6561 | CAGATGGGTACTTCTG | k-d10-kekek | 44 | 341 |
| 969073 | N/A | N/A | 8827 | 8842 | TTTAAACTCAGGTGAC | k-d10-kekek | 45 | 1675 |
| 969083 | N/A | N/A | 5412 | 5427 | ATTCTCATGGTACAGG | k-d10-kekek | 83 | 677 |
| 969093 | N/A | N/A | 8237 | 8252 | GAGTATTGTTTTGTG | k-d10-kekek | 90 | 1899 |
| 969103 | 968 | 983 | 13059 | 13074 | GTATTGCCAGCTAAGG | k-d9-kekeke | 70 | 1410 |
| 969113 | N/A | N/A | 7920 | 7935 | AATTATGGAATTGCAG | k-d9-kekeke | 55 | 1923 |
| 969123 | N/A | N/A | 8830 | 8845 | AGCTTTAAACTCAGGT | k-d9-kekeke | 52 | 1920 |
| 969133 | N/A | N/A | 5854 | 5869 | TTTGTAAGTGCAACCA | k-d9-kekeke | 95 | 1095 |
| 969143 | N/A | N/A | 8366 | 8381 | CTTTATACCAGTGTCT | k-d9-kekeke | 92 | 1890 |
| 969153 | 2251 | 2266 | 14342 | 14357 | CGTCAATATATTCTTT | kek-d9-eekk | 93 | 1925 |
| 969163 | N/A | N/A | 6818 | 6833 | ACGCAATGCTGACTTG | kek-d9-eekk | 91 | 1905 |
| 969183 | N/A | N/A | 5857 | 5872 | AGTTTTGTAAGTGCAA | kk-d10-keke | 92 | 1917 |
| 969193 | N/A | N/A | 8742 | 8757 | TCTATTAGAGGGCTAG | kk-d10-keke | 72 | 150 |
| 969203 | 2340 | 2355 | 14431 | 14446 | GTTCTAACTCTTGGGC | kk-d10-keke | 84 | 243 |
| 969213 | N/A | N/A | 8164 | 8179 | CATTCAGAATTTCCAC | kk-d10-keke | 84 | 1730 |
| 969223 | 1032 | 1047 | 13123 | 13138 | AAGATTGGCTCTGGCT | kk-d8-eeeekk | 55 | 1411 |
| 969233 | N/A | N/A | 7921 | 7936 | GAATTATGGAATTGCA | kk-d8-eeeekk | 95 | 1183 |
| 969253 | N/A | N/A | 6700 | 6715 | ATTTCTTGATGTGGTG | kk-d8-kekekk | 69 | 343 |
| 969273 | N/A | N/A | 6547 | 6562 | TCAGATGGGTACTTCT | kk-d8-kekekk | 62 | 411 |
| 969293 | N/A | N/A | 5450 | 5465 | TGTTATATTTGATCCT | kk-d8-kekekk | 46 | 1887 |
| 969303 | N/A | N/A | 8333 | 8348 | ACACATCATTGGGTTA | kk-d8-kekekk | 20 | 426 |
| 969313 | N/A | N/A | 5448 | 5463 | TTATATTTGATCCTCA | kk-d9-eeekk | 96 | 1909 |
| 969323 | N/A | N/A | 8320 | 8335 | TTATGAAATTATTGGT | kk-d9-eeekk | 39 | 1910 |
| 969333 | 970 | 985 | 13061 | 13076 | AAGTATTGCCAGCTAA | kk-d9-eeekk | 63 | 1911 |
| 969343 | N/A | N/A | 6702 | 6717 | GTATTTCTTGATGTGG | kk-d9-eeekk | 97 | 413 |
| 969363 | N/A | N/A | 5859 | 5874 | GCAGTTTTGTAAGTGC | kk-d9-eeekk | 79 | 1647 |
| 969373 | N/A | N/A | 8745 | 8760 | AATTCTATTAGAGGGC | kk-d9-eeekk | 73 | 1396 |
| 969383 | N/A | N/A | 5414 | 5429 | TTATTCTCATGGTACA | kk-d9-eeekk | 48 | 1927 |
| 969393 | N/A | N/A | 8323 | 8338 | GGGTTATGAAATTATT | kk-d9-eeekk | 77 | 1935 |
| 969403 | N/A | N/A | 5448 | 5463 | TTATATTTGATCCTCA | kk-d9-ekeke | 96 | 1909 |
| 969413 | N/A | N/A | 8320 | 8335 | TTATGAAATTATTGGT | kk-d9-ekeke | 74 | 1910 |
| 969423 | 970 | 985 | 13061 | 13076 | AAGTATTGCCAGCTAA | kk-d9-ekeke | 49 | 1911 |
| 969433 | N/A | N/A | 6702 | 6717 | GTATTTCTTGATGTGG | kk-d9-ekeke | 96 | 413 |
| 969453 | N/A | N/A | 5452 | 5467 | CGTGTTATATTTGATC | kk-d9-ekeke | 76 | 1906 |

TABLE 38-continued

Inhibition of APOL1 mRNA by deoxy, MOE, and cEt gapmers targeting SEQ ID NO: 1 and 2

| Compound Number | SEQ ID: 1 Start Site | SEQ ID: 1 Stop Site | SEQ ID: 2 Start Site | SEQ ID: 2 Stop Site | Sequence | Chemistry | % inhibition | SEQ ID NO |
|---|---|---|---|---|---|---|---|---|
| 969463 | N/A | N/A | 8335 | 8350 | CAACACATCATTGGGT | kk-d9-ekeke | 80 | 1907 |
| 969473 | N/A | N/A | 5411 | 5426 | TTCTCATGGTACAGGA | kk-d9-kdkdk | 89 | 607 |
| 969483 | N/A | N/A | 8236 | 8251 | AGTATTGTTTTGTGG | kk-d9-kdkdk | 72 | 1922 |
| 969493 | N/A | N/A | 8306 | 8321 | GTTCAAAAGCAGCATT | kk-d9-kdkdk | 73 | 13 |
| 969503 | N/A | N/A | 6548 | 6563 | ATCAGATGGGTACTTC | kk-d9-kdkdk | 78 | 481 |
| 971923 | N/A | N/A | 5857 | 5872 | AGTTTTGTAAGTGCAA | kk-d9-kekek | 81 | 1917 |
| 971933 | N/A | N/A | 8742 | 8757 | TCTATTAGAGGGCTAG | kk-d9-kekek | 52 | 150 |
| 971943 | 2342 | 2357 | 14433 | 14448 | CTGTTCTAACTCTTGG | kk-d9-kekek | 88 | 383 |
| 971953 | N/A | N/A | 7924 | 7939 | TGGGAATTATGGAATT | kk-d9-kekek | 87 | 1929 |
| 971963 | N/A | N/A | 8830 | 8845 | AGCTTTAAACTCAGGT | kk-d9-kekek | 87 | 1920 |
| 971973 | N/A | N/A | 5858 | 5873 | CAGTTTTGTAAGTGCA | kk-d9-kekek | 91 | 1577 |
| 971983 | N/A | N/A | 8744 | 8759 | ATTCTATTAGAGGGCT | kk-d9-kekek | 46 | 1326 |
| 971993 | 970 | 985 | 13061 | 13076 | AAGTATTGCCAGCTAA | kkk-d8-kdkdk | 54 | 1911 |
| 972003 | N/A | N/A | 6548 | 6563 | ATCAGATGGGTACTTC | kkk-d8-kdkdk | 79 | 481 |
| 972013 | N/A | N/A | 8744 | 8759 | ATTCTATTAGAGGGCT | kkk-d8-kdkdk | 78 | 1326 |
| 972023 | N/A | N/A | 5449 | 5464 | GTTATATTTGATCCTC | kkk-d8-kekek | 66 | 1900 |
| 972033 | N/A | N/A | 8332 | 8347 | CACATCATTGGGTTAT | kkk-d8-kekek | 58 | 356 |
| 972043 | 1035 | 1050 | 13126 | 13141 | CTGAAGATTGGCTCTG | kkk-d8-kekek | 36 | 1939 |
| 972053 | N/A | N/A | 6704 | 6719 | GTGTATTTCTTGATGT | kkk-d8-kekek | 84 | 1940 |
| 972063 | N/A | N/A | 8831 | 8846 | AAGCTTTAAACTCAGG | kkk-d8-kekek | 16 | 1327 |
| 972073 | N/A | N/A | 5450 | 5465 | TGTTATATTTGATCCT | kkk-d8-kekek | 59 | 1887 |
| 972083 | N/A | N/A | 8333 | 8348 | ACACATCATTGGGTTA | kkk-d8-kekek | 32 | 426 |
| 972093 | 2341 | 2356 | 14432 | 14447 | TGTTCTAACTCTTGGG | kkk-d9-keke | 88 | 313 |
| 972103 | N/A | N/A | 8165 | 8180 | GCATTCAGAATTTCCA | kkk-d9-keke | 84 | 1937 |
| 972113 | N/A | N/A | 8306 | 8321 | GTTCAAAAGCAGCATT | kkk-d9-keke | 85 | 13 |
| 972123 | N/A | N/A | 6548 | 6563 | ATCAGATGGGTACTTC | kkk-d9-keke | 85 | 481 |
| 972133 | N/A | N/A | 8829 | 8844 | GCTTTAAACTCAGGTG | kkk-d9-keke | 82 | 81 |
| 972143 | N/A | N/A | 5853 | 5868 | TTGTAAGTGCAACCAA | kkk-d9-kkke | 78 | 1025 |
| 972153 | N/A | N/A | 8365 | 8380 | TTTATACCAGTGTCTT | kkk-d9-kkke | 80 | 1914 |
| 972163 | 2251 | 2266 | 14342 | 14357 | CGTCAATATATTCTTT | kkk-d9-kkke | 95 | 1925 |
| 972173 | N/A | N/A | 7922 | 7937 | GGAATTATGGAATTGC | kkk-d9-kkke | 65 | 1249 |
| 972183 | N/A | N/A | 8307 | 8322 | GGTTCAAAAGCAGCAT | kkk-d9-kkke | 74 | 978 |
| 972193 | N/A | N/A | 6703 | 6718 | TGTATTTCTTGATGTG | kkk-d9-kkke | 87 | 1926 |

Example 2: Dose-Dependent Antisense Inhibition of Human APOL1 in A431 Cells

Gapmers from Example 1 exhibiting significant in vitro inhibition of APOL1 mRNA were selected and tested at various doses in A431 cells. The antisense oligonucleotides were tested in a series of experiments that had similar culture conditions. The results for each experiment are presented in separate tables shown below.

Cells were plated at a density of 10,000 cells per well and transfected free uptake with various concentrations of 3-10-3 cEt gapmers, as specified in the Tables below. After a treatment period of approximately 16 hours, RNA was isolated from the cells and APOL1 mRNA levels were measured by quantitative real-time PCR. Human primer probe set RTS35962 was used to measure mRNA levels. APOL1 mRNA levels were adjusted according to total RNA content, as measured by RIBOGREEN®. Results are presented as percent inhibition of APOL1, relative to untreated control cells.

The half maximal inhibitory concentration ($IC_{50}$) of each oligonucleotide is also presented. APOL1 mRNA levels were significantly reduced in a dose-dependent manner in antisense oligonucleotide treated cells.

TABLE 39

Multi-dose assay with 3-10-3 cEt gapmers

| Compound Number | % inhibition 62.5 nM | 250 nM | 1,000 nM | 4,000 nM | $IC_{50}$ (µm) |
|---|---|---|---|---|---|
| 793406 | 19 | 60 | 83 | 93 | 0.2 |
| 903830 | 54 | 85 | 95 | 97 | <0.1 |
| 903862 | 49 | 69 | 88 | 93 | <0.1 |
| 903894 | 41 | 67 | 87 | 94 | 0.1 |
| 904119 | 49 | 70 | 82 | 85 | <0.1 |
| 904758 | 36 | 63 | 83 | 92 | 0.1 |
| 904760 | 75 | 93 | 99 | 99 | <0.1 |
| 904823 | 50 | 74 | 85 | 91 | <0.1 |
| 905142 | 32 | 74 | 90 | 95 | 0.1 |
| 905143 | 52 | 76 | 92 | 97 | <0.1 |
| 905270 | 44 | 78 | 90 | 94 | <0.1 |
| 905271 | 44 | 66 | 86 | 91 | 0.1 |
| 905398 | 59 | 82 | 94 | 96 | <0.1 |
| 905462 | 42 | 73 | 90 | 95 | 0.1 |
| 905463 | 42 | 67 | 85 | 94 | 0.1 |
| 905494 | 51 | 73 | 84 | 91 | <0.1 |
| 905654 | 57 | 74 | 92 | 94 | <0.1 |
| 905655 | 61 | 80 | 90 | 94 | <0.1 |

TABLE 40

Multi-dose assay with 3-10-3 cEt gapmers

| Compound Number | % inhibition 62.5 nM | 250 nM | 1,000 nM | 4,000 nM | $IC_{50}$ (µm) |
|---|---|---|---|---|---|
| 793406 | 15 | 58 | 82 | 88 | 0.3 |
| 903544 | 46 | 72 | 87 | 92 | <0.1 |
| 904026 | 62 | 88 | 96 | 98 | <0.1 |
| 904058 | 62 | 83 | 94 | 98 | <0.1 |
| 904121 | 50 | 78 | 86 | 90 | <0.1 |
| 904216 | 32 | 64 | 78 | 82 | 0.2 |
| 904761 | 19 | 46 | 78 | 92 | 0.3 |
| 905114 | 36 | 73 | 88 | 91 | 0.1 |
| 905144 | 35 | 50 | 75 | 82 | 0.2 |
| 905146 | 42 | 71 | 87 | 97 | 0.1 |
| 905401 | 52 | 79 | 89 | 94 | <0.1 |
| 905402 | 57 | 82 | 94 | 96 | <0.1 |
| 905496 | 29 | 68 | 90 | 93 | 0.1 |
| 905497 | 78 | 91 | 95 | 96 | <0.1 |
| 905498 | 60 | 84 | 94 | 94 | <0.1 |
| 905657 | 47 | 67 | 84 | 93 | 0.1 |
| 905688 | 25 | 71 | 86 | 92 | 0.2 |
| 905689 | 68 | 87 | 93 | 94 | <0.1 |
| 905690 | 57 | 78 | 88 | 92 | <0.1 |

TABLE 41

Multi-dose assay with 3-10-3 cEt gapmers

| Compound Number | % inhibition 62.5 nM | 250 nM | 1,000 nM | 4,000 nM | $IC_{50}$ (µm) |
|---|---|---|---|---|---|
| 793406 | 10 | 57 | 83 | 92 | 0.3 |
| 903644 | 35 | 72 | 85 | 92 | 0.1 |
| 903996 | 50 | 79 | 88 | 97 | <0.1 |
| 904027 | 28 | 61 | 81 | 88 | 0.2 |
| 904443 | 54 | 84 | 96 | 98 | <0.1 |
| 904444 | 74 | 91 | 96 | 98 | <0.1 |
| 904763 | 70 | 91 | 97 | 98 | <0.1 |
| 904764 | 47 | 84 | 95 | 99 | <0.1 |
| 904828 | 79 | 92 | 97 | 97 | <0.1 |
| 905020 | 46 | 73 | 90 | 95 | <0.1 |
| 905147 | 37 | 71 | 87 | 93 | 0.1 |
| 905148 | 22 | 60 | 83 | 94 | 0.2 |
| 905276 | 29 | 63 | 83 | 92 | 0.2 |
| 905370 | 8 | 46 | 74 | 84 | 0.4 |
| 905371 | 38 | 67 | 86 | 94 | 0.1 |
| 905372 | 59 | 82 | 92 | 95 | <0.1 |
| 905468 | 40 | 67 | 87 | 94 | 0.1 |
| 905499 | 72 | 87 | 92 | 93 | <0.1 |
| 905691 | 53 | 77 | 85 | 92 | <0.1 |

TABLE 42

Multi-dose assay with 3-10-3 cEt gapmers

| Compound Number | % inhibition 62.5 nM | 250 nM | 1,000 nM | 4,000 nM | $IC_{50}$ (µm) |
|---|---|---|---|---|---|
| 793406 | 12 | 56 | 81 | 92 | 0.3 |
| 903613 | 47 | 68 | 81 | 88 | <0.1 |
| 903805 | 28 | 58 | 75 | 82 | 0.2 |
| 903998 | 56 | 86 | 93 | 96 | <0.1 |
| 904029 | 34 | 58 | 79 | 88 | 0.2 |
| 904030 | 45 | 78 | 92 | 96 | <0.1 |
| 904253 | 46 | 74 | 85 | 92 | <0.1 |
| 904766 | 96 | 98 | 99 | 99 | <0.1 |
| 904829 | 41 | 75 | 84 | 89 | 0.1 |
| 905021 | 38 | 73 | 90 | 95 | 0.1 |
| 905022 | 47 | 76 | 92 | 97 | <0.1 |
| 905149 | 38 | 65 | 85 | 93 | 0.1 |
| 905277 | 24 | 50 | 80 | 92 | 0.3 |
| 905373 | 74 | 93 | 98 | 99 | <0.1 |
| 905404 | 27 | 58 | 77 | 88 | 0.2 |
| 905501 | 29 | 67 | 86 | 92 | 0.1 |
| 905565 | 20 | 49 | 73 | 89 | 0.3 |
| 905757 | 18 | 56 | 78 | 86 | 0.3 |
| 905758 | 26 | 65 | 85 | 92 | 0.2 |

TABLE 43

Multi-dose assay with 3-10-3 cEt gapmers

| Compound Number | % inhibition 62.5 nM | 250 nM | 1,000 nM | 4,000 nM | IC$_{50}$ (μm) |
|---|---|---|---|---|---|
| 793406 | 36 | 64 | 85 | 94 | 0.1 |
| 903807 | 46 | 78 | 90 | 95 | <0.1 |
| 903872 | 38 | 72 | 88 | 94 | 0.1 |
| 903999 | 32 | 66 | 83 | 91 | 0.1 |
| 904000 | 90 | 98 | 99 | 100 | <0.1 |
| 904001 | 95 | 99 | 100 | 100 | <0.1 |
| 904063 | 24 | 65 | 81 | 89 | 0.2 |
| 904223 | 47 | 75 | 84 | 89 | <0.1 |
| 904224 | 60 | 86 | 91 | 94 | <0.1 |
| 904254 | 35 | 62 | 82 | 86 | 0.1 |
| 904862 | 9 | 49 | 64 | 89 | 0.4 |
| 905086 | 28 | 55 | 80 | 89 | 0.2 |
| 905120 | 70 | 90 | 97 | 98 | <0.1 |
| 905374 | 48 | 70 | 80 | 88 | <0.1 |
| 905407 | 38 | 67 | 86 | 93 | 0.1 |
| 905408 | 23 | 61 | 83 | 92 | 0.2 |
| 905471 | 59 | 82 | 86 | 86 | <0.1 |
| 905600 | 52 | 81 | 94 | 98 | <0.1 |
| 905631 | 32 | 52 | 71 | 83 | 0.2 |

TABLE 44

Multi-dose assay with 3-10-3 cEt gapmers

| Compound Number | % inhibition 62.5 nM | 250 nM | 1,000 nM | 4,000 nM | IC$_{50}$ (μm) |
|---|---|---|---|---|---|
| 793406 | 17 | 59 | 83 | 91 | 0.2 |
| 903874 | 44 | 70 | 87 | 95 | 0.1 |
| 903939 | 64 | 87 | 94 | 97 | <0.1 |
| 904002 | 53 | 82 | 92 | 97 | <0.1 |
| 904003 | 47 | 76 | 90 | 96 | <0.1 |
| 904034 | 41 | 70 | 88 | 94 | 0.1 |
| 904226 | 77 | 95 | 98 | 99 | <0.1 |
| 904675 | 80 | 95 | 99 | 99 | <0.1 |
| 905121 | 64 | 87 | 93 | 95 | <0.1 |
| 905123 | 62 | 85 | 92 | 95 | <0.1 |
| 905473 | 47 | 61 | 65 | 61 | <0.1 |
| 905475 | 43 | 71 | 90 | 96 | 0.1 |
| 905505 | 58 | 87 | 95 | 97 | <0.1 |
| 905601 | 49 | 79 | 92 | 96 | <0.1 |
| 905633 | 51 | 81 | 92 | 94 | <0.1 |
| 905634 | 54 | 82 | 91 | 96 | <0.1 |
| 905665 | 30 | 76 | 91 | 94 | 0.1 |
| 905697 | 51 | 78 | 92 | 96 | <0.1 |
| 905698 | 85 | 97 | 99 | 99 | <0.1 |

TABLE 45

Multi-dose assay with 3-10-3 cEt gapmers

| Compound Number | % inhibition 62.5 nM | 250 nM | 1,000 nM | 4,000 nM | IC$_{50}$ (μm) |
|---|---|---|---|---|---|
| 793406 | 73 | 85 | 92 | 95 | <0.1 |
| 903940 | 64 | 83 | 92 | 96 | <0.1 |
| 904101 | 74 | 85 | 92 | 94 | <0.1 |
| 904102 | 75 | 88 | 94 | 96 | <0.1 |
| 904420 | 22 | 40 | 58 | 62 | 0.8 |
| 904452 | 78 | 88 | 93 | 96 | <0.1 |
| 904484 | 76 | 87 | 92 | 96 | <0.1 |
| 904515 | 43 | 72 | 85 | 91 | 0.1 |
| 904517 | 78 | 89 | 92 | 93 | <0.1 |
| 905028 | 63 | 82 | 90 | 93 | <0.1 |
| 905029 | 85 | 88 | 93 | 96 | <0.1 |
| 905093 | 58 | 82 | 91 | 95 | <0.1 |
| 905094 | 95 | 99 | 99 | 99 | <0.1 |
| 905476 | 54 | 85 | 95 | 97 | <0.1 |
| 905477 | 78 | 93 | 96 | 98 | <0.1 |
| 905510 | 65 | 84 | 90 | 94 | <0.1 |
| 905636 | 17 | 45 | 69 | 78 | 0.4 |
| 905667 | 41 | 65 | 82 | 89 | 0.1 |
| 905700 | 75 | 88 | 92 | 95 | <0.1 |

TABLE 46

Multi-dose assay with 3-10-3 cEt gapmers

| Compound Number | % inhibition 62.5 nM | 250 nM | 1,000 nM | 4,000 nM | IC$_{50}$ (μm) |
|---|---|---|---|---|---|
| 793406 | 68 | 81 | 90 | 95 | <0.1 |
| 903976 | 80 | 90 | 95 | 97 | <0.1 |
| 904103 | 61 | 79 | 87 | 91 | <0.1 |
| 904104 | 85 | 92 | 95 | 97 | <0.1 |
| 904264 | 72 | 81 | 85 | 85 | <0.1 |
| 904424 | 41 | 75 | 91 | 95 | 0.1 |
| 904680 | 74 | 87 | 94 | 96 | <0.1 |
| 904743 | 46 | 68 | 86 | 93 | 0.1 |
| 904744 | 82 | 92 | 97 | 98 | <0.1 |
| 904840 | 66 | 81 | 89 | 93 | <0.1 |
| 904871 | 64 | 75 | 90 | 95 | <0.1 |
| 904872 | 68 | 82 | 93 | 96 | <0.1 |
| 904968 | 53 | 78 | 89 | 94 | <0.1 |
| 905031 | 38 | 66 | 83 | 89 | 0.1 |
| 905032 | 53 | 78 | 89 | 93 | <0.1 |
| 905095 | 83 | 95 | 97 | 98 | <0.1 |
| 905479 | 82 | 89 | 94 | 95 | <0.1 |
| 905511 | 54 | 75 | 87 | 90 | <0.1 |
| 905704 | 61 | 84 | 93 | 96 | <0.1 |

TABLE 47

Multi-dose assay with 3-10-3 cEt gapmers

| Compound Number | % inhibition 62.5 nM | 250 nM | 1,000 nM | 4,000 nM | IC$_{50}$ (μm) |
|---|---|---|---|---|---|
| 793406 | 21 | 63 | 83 | 93 | 0.2 |
| 904009 | 35 | 68 | 88 | 95 | 0.1 |
| 904041 | 67 | 88 | 95 | 97 | <0.1 |
| 904202 | 24 | 62 | 77 | 88 | 0.2 |
| 904425 | 84 | 97 | 99 | 99 | <0.1 |
| 904426 | 37 | 72 | 90 | 95 | 0.1 |
| 904522 | 37 | 73 | 86 | 94 | 0.1 |
| 904619 | 49 | 83 | 94 | 98 | <0.1 |
| 904681 | 28 | 62 | 86 | 94 | 0.2 |
| 904713 | 23 | 53 | 72 | 82 | 0.3 |
| 904745 | 58 | 83 | 94 | 97 | <0.1 |
| 904746 | 75 | 92 | 98 | 99 | <0.1 |
| 904778 | 54 | 80 | 92 | 96 | <0.1 |
| 904873 | 50 | 80 | 93 | 97 | <0.1 |
| 904969 | 35 | 71 | 88 | 95 | 0.1 |
| 905128 | 42 | 70 | 83 | 88 | 0.1 |
| 905418 | 42 | 78 | 90 | 95 | <0.1 |
| 905513 | 38 | 73 | 90 | 95 | 0.1 |
| 905706 | 32 | 70 | 84 | 89 | 0.1 |

TABLE 48

Multi-dose assay with 3-10-3 cEt gapmers

| Compound Number | 62.5 nM | 250 nM | 1,000 nM | 4,000 nM | IC$_{50}$ (μm) |
|---|---|---|---|---|---|
| 793406 | 12 | 55 | 80 | 90 | 0.3 |
| 903820 | 56 | 85 | 94 | 98 | <0.1 |
| 903821 | 63 | 89 | 97 | 98 | <0.1 |
| 904523 | 40 | 72 | 90 | 95 | 0.1 |
| 904716 | 33 | 63 | 85 | 92 | 0.1 |
| 904717 | 53 | 82 | 93 | 97 | <0.1 |
| 904718 | 39 | 73 | 88 | 95 | 0.1 |
| 904747 | 47 | 79 | 91 | 94 | <0.1 |
| 904748 | 60 | 83 | 93 | 95 | <0.1 |
| 905036 | 52 | 77 | 91 | 95 | <0.1 |
| 905292 | 46 | 75 | 91 | 95 | <0.1 |
| 905419 | 41 | 71 | 84 | 88 | 0.1 |
| 905422 | 19 | 59 | 88 | 97 | 0.2 |
| 905485 | 32 | 61 | 80 | 92 | 0.2 |
| 905580 | 35 | 71 | 89 | 96 | 0.1 |
| 905581 | 39 | 70 | 89 | 95 | 0.1 |
| 905582 | 19 | 65 | 86 | 94 | 0.2 |
| 905707 | 50 | 76 | 89 | 91 | <0.1 |
| 905867 | 33 | 67 | 84 | 92 | 0.1 |

TABLE 49

Multi-dose assay with 3-10-3 cEt gapmers

| Compound Number | 62.5 nM | 250 nM | 1,000 nM | 4,000 nM | IC$_{50}$ (μm) |
|---|---|---|---|---|---|
| 793406 | 15 | 56 | 79 | 91 | 0.3 |
| 903825 | 72 | 89 | 94 | 95 | <0.1 |
| 903856 | 68 | 75 | 89 | N/A | <0.1 |
| 904209 | 61 | 89 | 96 | 96 | <0.1 |
| 904210 | 65 | 90 | 97 | 98 | <0.1 |
| 904720 | 31 | 70 | 92 | 95 | 0.1 |
| 905456 | 48 | 85 | 91 | 94 | <0.1 |
| 905457 | 45 | 70 | 84 | 89 | <0.1 |
| 905520 | 36 | 68 | 96 | 97 | 0.1 |
| 905521 | 30 | 65 | 88 | 97 | 0.1 |
| 905712 | 25 | 60 | 86 | 94 | 0.2 |
| 905808 | 37 | 74 | 90 | 92 | 0.1 |

TABLE 50

Multi-dose assay with 3-10-3 cEt gapmers

| Compound Number | 62.5 nM | 250 nM | 1,000 nM | 4,000 nM | IC$_{50}$ (μm) |
|---|---|---|---|---|---|
| 793406 | 9 | 59 | 85 | 94 | 0.3 |
| 903826 | 47 | 81 | 93 | 97 | <0.1 |
| 903956 | 48 | 74 | 88 | 94 | <0.1 |
| 904082 | 56 | 84 | 93 | 95 | <0.1 |
| 904083 | 82 | 95 | 97 | 98 | <0.1 |
| 904084 | 83 | 96 | 98 | 98 | <0.1 |
| 904114 | 48 | 71 | 86 | 89 | <0.1 |
| 904211 | 62 | 88 | 96 | 98 | <0.1 |
| 904212 | 79 | 93 | 97 | 98 | <0.1 |
| 904242 | 33 | 61 | 81 | 89 | 0.2 |
| 904626 | 25 | 55 | 82 | 93 | 0.2 |
| 904627 | 86 | 93 | 99 | 99 | <0.1 |
| 904628 | 67 | 90 | 98 | 99 | <0.1 |
| 905139 | 54 | 83 | 94 | 97 | <0.1 |
| 905140 | 35 | 71 | 88 | 95 | 0.1 |
| 905490 | 66 | 85 | 91 | 92 | <0.1 |
| 905491 | 74 | 91 | 95 | 96 | <0.1 |
| 905586 | 35 | 63 | 81 | 88 | 0.1 |
| 905684 | 57 | 86 | 95 | 97 | <0.1 |

Cells were also plated at a density of 10,000 cells per well and transfected free uptake with various concentrations of antisense oligonucleotide, as specified in the Tables below. After a treatment period of approximately 16 hours, RNA was isolated from the cells and APOL1 mRNA levels were measured by quantitative real-time PCR. Human primer probe set HTS7376 (forward sequence GGCAGCCTTGTACTCTTGGAA, designated herein as SEQ ID NO: 1942; reverse sequence GCTGGTAATCCCGGTCAAAG, designated herein as SEQ ID NO: 1943; probe sequence CTGGGATG-GAGTTGGGAATCACAGCCX, designated herein as SEQ ID NO: 1944) was used to measure mRNA levels. APOL1 mRNA levels were adjusted according to total RNA content, as measured by RIBOGREEN®. Results are presented as percent inhibition of APOL1, relative to untreated control cells.

The half maximal inhibitory concentration (IC$_{50}$) of each oligonucleotide is also presented. APOL1 mRNA levels were significantly reduced in a dose-dependent manner in antisense oligonucleotide treated cells.

TABLE 51

Multi-dose assay with 3-10-3 cEt gapmers

| Compound Number | 62.5 nM | 250 nM | 1,000 nM | 4,000 nM | IC$_{50}$ (μm) |
|---|---|---|---|---|---|
| 793406 | 73 | 84 | 90 | 95 | <0.1 |
| 903807 | 59 | 83 | 91 | 95 | <0.1 |
| 903872 | 69 | 76 | 86 | 90 | <0.1 |
| 903999 | 76 | 85 | 93 | 94 | <0.1 |
| 904000 | 83 | 94 | 96 | 97 | <0.1 |
| 904001 | 95 | 97 | 98 | 98 | <0.1 |
| 904063 | 71 | 83 | 89 | 92 | <0.1 |
| 904223 | 38 | 48 | 63 | 74 | 0.3 |
| 904224 | 83 | 91 | 93 | 95 | <0.1 |
| 904254 | 28 | 50 | 72 | 72 | 0.3 |
| 904862 | 0 | 30 | 55 | 74 | 1.0 |
| 905086 | 8 | 32 | 65 | 72 | 0.7 |
| 905120 | 79 | 88 | 94 | 96 | <0.1 |
| 905374 | 59 | 67 | 77 | 82 | <0.1 |
| 905407 | 62 | 83 | 88 | 93 | <0.1 |
| 905408 | 68 | 82 | 90 | 94 | <0.1 |
| 905471 | 37 | 55 | 64 | 47 | 0.4 |
| 905600 | 73 | 88 | 93 | 97 | <0.1 |
| 905631 | 19 | 39 | 51 | 69 | 0.8 |

TABLE 52

Multi-dose assay with 3-10-3 cEt gapmers

| Compound Number | 62.5 nM | 250 nM | 1,000 nM | 4,000 nM | IC$_{50}$ (μm) |
|---|---|---|---|---|---|
| 793406 | 71 | 83 | 91 | 95 | <0.1 |
| 903874 | 27 | 52 | 76 | 87 | 0.2 |

TABLE 52-continued

Multi-dose assay with 3-10-3 cEt gapmers

| Compound Number | % inhibition 62.5 nM | 250 nM | 1,000 nM | 4,000 nM | $IC_{50}$ (μm) |
|---|---|---|---|---|---|
| 903939 | 82 | 92 | 96 | 97 | <0.1 |
| 904002 | 39 | 65 | 81 | 91 | 0.1 |
| 904003 | 62 | 82 | 90 | 94 | <0.1 |
| 904034 | 55 | 74 | 87 | 90 | <0.1 |
| 904226 | 60 | 85 | 91 | 93 | <0.1 |
| 904675 | 81 | 94 | 98 | 99 | <0.1 |
| 905121 | 78 | 89 | 93 | 95 | <0.1 |
| 905123 | 83 | 92 | 95 | 96 | <0.1 |
| 905473 | 82 | 86 | 86 | 88 | <0.1 |
| 905475 | 72 | 83 | 91 | 95 | <0.1 |
| 905505 | 42 | 73 | 87 | 91 | 0.1 |
| 905601 | 49 | 76 | 89 | 95 | <0.1 |
| 905633 | 40 | 72 | 84 | 86 | 0.1 |
| 905634 | 53 | 76 | 88 | 91 | <0.1 |
| 905665 | 61 | 79 | 89 | 93 | <0.1 |
| 905697 | 34 | 70 | 84 | 88 | 0.1 |
| 905698 | 91 | 97 | 99 | 99 | <0.1 |

TABLE 53

Multi-dose assay with 3-10-3 cEt gapmers

| Compound Number | % inhibition 62.5 nM | 250 nM | 1,000 nM | 4,000 nM | $IC_{50}$ (μm) |
|---|---|---|---|---|---|
| 793406 | 64 | 83 | 91 | 94 | <0.1 |
| 903501 | 65 | 82 | 95 | 95 | <0.1 |
| 903543 | 65 | 80 | 92 | 95 | <0.1 |
| 903596 | 100 | 84 | 91 | 95 | <0.1 |
| 903639 | 37 | 35 | 62 | 61 | 0.6 |
| 903991 | 22 | 42 | 44 | 44 | >4.0 |
| 903997 | 25 | 54 | 77 | 85 | 0.2 |
| 904055 | 39 | 47 | 76 | 89 | 0.2 |
| 904509 | 51 | 45 | 52 | 43 | 0.1 |
| 904629 | 30 | 58 | 83 | 86 | 0.2 |
| 905005 | 32 | 48 | 63 | 63 | 0.4 |
| 905015 | 39 | 58 | 72 | 81 | 0.1 |
| 905019 | 34 | 63 | 78 | 86 | 0.1 |
| 905037 | 42 | 63 | 69 | 75 | 0.1 |
| 905111 | 3 | 44 | 36 | 70 | 1.2 |
| 905141 | 14 | 50 | 76 | 92 | 0.3 |
| 905269 | 38 | 58 | 84 | 92 | 0.1 |
| 905469 | 56 | 81 | 90 | 95 | <0.1 |
| 905685 | 54 | 76 | 95 | 95 | <0.1 |

TABLE 54

Multi-dose assay with 3-10-3 cEt gapmers

| Compound Number | % inhibition 62.5 nM | 250 nM | 1,000 nM | 4,000 nM | $IC_{50}$ (μm) |
|---|---|---|---|---|---|
| 793406 | 18 | 54 | 78 | 84 | 0.3 |
| 903545 | 51 | 68 | 75 | 86 | <0.1 |
| 903557 | 30 | 54 | 65 | 72 | 0.3 |
| 903558 | 55 | 69 | 70 | 83 | <0.1 |
| 903564 | 57 | 65 | 64 | 79 | <0.1 |
| 903572 | 40 | 60 | 82 | 90 | 0.1 |
| 903573 | 48 | 66 | 65 | 80 | <0.1 |
| 903574 | 29 | 44 | 58 | 56 | 0.8 |
| 903585 | 40 | 66 | 63 | 70 | 0.1 |
| 903587 | 37 | 43 | 58 | 81 | 0.3 |
| 903595 | 56 | 72 | 79 | 88 | <0.1 |
| 903597 | 51 | 60 | 69 | 66 | <0.1 |
| 903598 | 28 | 27 | 65 | 62 | 0.8 |
| 903599 | 31 | 58 | 64 | 79 | 0.2 |
| 903600 | 43 | 61 | 61 | 79 | 0.1 |
| 903606 | 57 | 73 | 84 | 91 | <0.1 |
| 903607 | 55 | 69 | 85 | 82 | <0.1 |
| 903639 | 17 | 0 | 23 | 39 | >4.0 |
| 905037 | 0 | 21 | 3 | 37 | >4.0 |

In another assay, cells were plated at a density of 10,000 cells per well and transfected free uptake with various concentrations of antisense oligonucleotide, as specified in the Tables below. After a treatment period of approximately 16 hours, RNA was isolated from the cells and APOL1 mRNA levels were measured by quantitative real-time PCR. Human primer probe set RTS35962 was used to measure mRNA levels. APOL1 mRNA levels were adjusted according to total RNA content, as measured by RIBOGREEN®. Results are presented as percent inhibition of APOL1, relative to untreated control cells.

The half maximal inhibitory concentration ($IC_{50}$) of each oligonucleotide is also presented. APOL1 mRNA levels were significantly reduced in a dose-dependent manner in antisense oligonucleotide treated cells.

TABLE 55

Multi-dose assay with 3-10-3 cEt gapmers

| Compound Number | % inhibition 4.8 nM | 19.5 nM | 78.1 nM | 312.5 nM | 1,250 nM | 5,000 nM | $IC_{50}$ (μM) |
|---|---|---|---|---|---|---|---|
| 793406 | 0 | 0 | 24 | 53 | 75 | 87 | 0.2 |
| 793444 | 0 | 0 | 4 | 21 | 31 | 53 | 0.9 |
| 903822 | 49 | 0 | 27 | 53 | 74 | 88 | 0.2 |
| 904082 | 1 | 14 | 57 | 87 | 91 | 90 | 0.1 |
| 904101 | 5 | 15 | 28 | 67 | 80 | 86 | 0.2 |
| 904226 | 11 | 22 | 71 | 94 | 98 | 99 | 0.1 |
| 904628 | 8 | 21 | 59 | 87 | 96 | 98 | 0.1 |
| 904763 | 13 | 17 | 46 | 85 | 95 | 98 | 0.1 |
| 905032 | 17 | 16 | 60 | 87 | 95 | 97 | 0.1 |

TABLE 56

Multi-dose assay with 3-10-3 cEt gapmers

| Compound Number | % inhibition 4.8 nM | 19.5 nM | 78.1 nM | 312.5 nM | 1,250 nM | 5,000 nM | $IC_{50}$ (μM) |
|---|---|---|---|---|---|---|---|
| 905139 | 0 | 0 | 48 | 82 | 91 | 96 | 0.2 |
| 905373 | 10 | 20 | 74 | 93 | 98 | 99 | 0.1 |
| 905469 | 11 | 0 | 38 | 73 | 88 | 96 | 0.2 |
| 905505 | 18 | 27 | 74 | 94 | 96 | 98 | 0.1 |
| 905521 | 13 | 2 | 35 | 75 | 88 | 95 | 0.2 |
| 905633 | 20 | 38 | 79 | 96 | 98 | 99 | 0.1 |
| 905634 | 14 | 22 | 60 | 90 | 96 | 98 | 0.1 |
| 905665 | 0 | 15 | 40 | 74 | 88 | 94 | 0.1 |
| 905758 | 31 | 0 | 30 | 61 | 85 | 89 | 0.2 |

In another assay, cells were plated at a density of 11,000 cells per well and transfected free uptake with various concentrations of antisense oligonucleotide, as specified in the Tables below. After a treatment period of approximately 16 hours, RNA was isolated from the cells and APOL1 mRNA levels were measured by quantitative real-time PCR. Human primer probe set RTS35962 was used to measure mRNA levels. APOL1 mRNA levels were adjusted according to total RNA content, as measured by RIBOGREEN®. Results are presented as percent inhibition of APOL1, relative to untreated control cells.

The half maximal inhibitory concentration ($IC_{50}$) of each oligonucleotide is also presented. APOL1 mRNA levels were significantly reduced in a dose-dependent manner in antisense oligonucleotide treated cells.

TABLE 57

Multi-dose assay with deoxy, MOE, and cEt gapmers

| Compound Number | Chemistry | % inhibition | | | | | $IC_{50}$ (µM) |
|---|---|---|---|---|---|---|---|
| | | 8 nM | 40 nM | 200 nM | 1000 nM | 5000 nM | |
| 969157 | kek-d9-eekk | 0 | 31 | 83 | 98 | 99 | 0.07 |
| 969162 | kek-d9-eekk | 20 | 70 | 98 | 99 | 99 | 0.02 |
| 969210 | kk-d10-keke | 12 | 64 | 96 | 98 | 99 | 0.03 |
| 969361 | kk-d9-eeekk | 13 | 52 | 94 | 98 | 99 | 0.04 |
| 969408 | kk-d9-ekeke | 10 | 53 | 91 | 98 | 99 | 0.04 |
| 969433 | kk-d9-ekeke | 8 | 58 | 92 | 96 | 96 | 0.03 |
| 969437 | kk-d9-ekeke | 14 | 47 | 91 | 97 | 98 | 0.04 |
| 969502 | kk-d9-kdkdk | 5 | 41 | 87 | 95 | 95 | 0.05 |
| 971997 | kkk-d8-kdkdk | 1 | 34 | 79 | 93 | 94 | 0.07 |
| 972002 | kkk-d8-kdkdk | 12 | 57 | 86 | 92 | 92 | 0.04 |
| 972116 | kkk-d9-keke | 14 | 53 | 90 | 96 | 96 | 0.04 |
| 972139 | kkk-d9-kkke | 20 | 59 | 94 | 99 | 99 | 0.03 |
| 972163 | kkk-d9-kkke | 20 | 65 | 94 | 96 | 96 | 0.02 |
| 972190 | kkk-d9-kkke | 19 | 38 | 84 | 97 | 99 | 0.05 |
| 972268 | kkk-d10-kkk | 15 | 42 | 81 | 91 | 93 | 0.05 |

In another assay, cells were plated at a density of 10,000 cells per well and transfected free uptake with various concentrations of antisense oligonucleotide, as specified in the Tables below. After a treatment period of approximately 16 hours, RNA was isolated from the cells and APOL1 mRNA levels were measured by quantitative real-time PCR. Human primer probe set RTS35962 was used to measure mRNA levels. APOL1 mRNA levels were adjusted according to total RNA content, as measured by RIBOGREEN®. Results are presented as percent inhibition of APOL1, relative to untreated control cells.

The half maximal inhibitory concentration ($IC_{50}$) of each oligonucleotide is also presented. APOL1 mRNA levels were significantly reduced in a dose-dependent manner in antisense oligonucleotide treated cells.

TABLE 58

Multi-dose assay with deoxy, MOE, and cEt gapmers

| Compound Number | Chemistry | % inhibition | | | | $IC_{50}$ (µM) |
|---|---|---|---|---|---|---|
| | | 15.6 nM | 62.5 nM | 250 nM | 1,000 nM | |
| 905095 | kkk-d10-kkk | 39 | 87 | 98 | 99 | <0.01 |
| 905491 | kkk-d10-kkk | 37 | 66 | 88 | 94 | 0.03 |
| 905634 | kkk-d10-kkk | 31 | 55 | 86 | 94 | 0.04 |
| 969064 | k-d10-kekek | 22 | 50 | 80 | 91 | 0.1 |
| 969084 | k-d10-kekek | 26 | 56 | 78 | 92 | 0.1 |
| 969164 | kek-d9-eekk | 23 | 63 | 90 | 97 | 0.05 |
| 969194 | kk-d10-keke | 26 | 56 | 81 | 92 | 0.1 |
| 969204 | kk-d10-keke | 11 | 47 | 82 | 94 | 0.1 |
| 969214 | kk-d10-keke | 33 | 75 | 91 | 96 | 0.02 |
| 969314 | kk-d9-eeekk | 2 | 31 | 67 | 89 | 0.1 |
| 969354 | kk-d9-eeekk | 15 | 48 | 76 | 92 | 0.1 |
| 969404 | kk-d9-ekeke | 8 | 37 | 69 | 64 | 0.2 |
| 969474 | kk-d9-kdkdk | 15 | 44 | 76 | 93 | 0.1 |
| 971944 | kk-d9-kekek | 25 | 59 | 84 | 93 | 0.05 |
| 971984 | kk-d9-kekek | 21 | 38 | 69 | 89 | 0.1 |
| 972014 | kkk-d8-kdkdk | 18 | 54 | 81 | 93 | 0.1 |
| 972044 | kkk-d8-kekek | 30 | 57 | 84 | 94 | 0.04 |
| 972124 | kkk-d9-keke | 50 | 80 | 96 | 97 | <0.01 |
| 972144 | kkk-d9-kkke | 15 | 60 | 87 | 94 | 0.1 |

TABLE 59

Multi-dose assay with deoxy, MOE, and cEt gapmers

| Compound Number | Chemistry | % inhibition | | | | $IC_{50}$ (µM) |
|---|---|---|---|---|---|---|
| | | 15.6 nM | 62.5 nM | 250 nM | 1,000 nM | |
| 905095 | kkk-d10-kkk | 38 | 88 | 98 | 99 | <0.01 |
| 969155 | kek-d9-eekk | 13 | 42 | 69 | 87 | 0.1 |
| 969175 | kk-d10-keke | 6 | 35 | 67 | 85 | 0.1 |
| 969185 | kk-d10-keke | 10 | 59 | 87 | 96 | 0.1 |
| 969205 | kk-d10-keke | 18 | 46 | 74 | 90 | 0.1 |
| 969254 | kk-d8-kekekk | 5 | 12 | 44 | 80 | 0.3 |
| 969345 | kk-d9-eeekk | 8 | 38 | 84 | 96 | 0.1 |
| 969355 | kk-d9-eeekk | 21 | 60 | 86 | 94 | 0.1 |
| 969434 | kk-d9-ekeke | 6 | 23 | 59 | 80 | 0.2 |
| 969435 | kk-d9-ekeke | 23 | 62 | 89 | 97 | 0.05 |
| 969475 | kk-d9-kdkdk | 9 | 38 | 68 | 89 | 0.1 |
| 971925 | kk-d9-kekek | 44 | 77 | 92 | 96 | <0.01 |
| 971995 | kkk-d8-kdkdk | 23 | 61 | 84 | 93 | 0.1 |
| 972004 | kkk-d8-kdkdk | 24 | 59 | 82 | 86 | 0.1 |
| 972104 | kkk-d9-keke | 16 | 47 | 74 | 90 | 0.1 |
| 972146 | kkk-d9-kkke | 45 | 78 | 95 | 98 | <0.01 |
| 972165 | kkk-d9-kkke | 2 | 46 | 76 | 87 | 0.1 |
| 972174 | kkk-d9-kkke | 5 | 25 | 64 | 82 | 0.2 |
| 972194 | kkk-d9-kkke | 3 | 24 | 54 | 80 | 0.2 |

TABLE 60

Multi-dose assay with deoxy, MOE, and cEt gapmers

| Compound Number | Chemistry | % inhibition | | | | $IC_{50}$ (µM) |
|---|---|---|---|---|---|---|
| | | 15.6 nM | 62.5 nM | 250 nM | 1,000 nM | |
| 905095 | kkk-d10-kkk | 63 | 94 | 99 | 99 | <0.01 |
| 969056 | k-d10-kekek | 29 | 50 | 70 | 87 | 0.1 |
| 969076 | k-d10-kekek | 14 | 46 | 80 | 92 | 0.1 |
| 969086 | k-d10-kekek | 24 | 58 | 86 | 96 | 0.1 |
| 969156 | kek-d9-eekk | 0 | 37 | 76 | 90 | 0.1 |
| 969157 | kek-d9-eekk | 37 | 71 | 91 | 98 | 0.02 |
| 969186 | kk-d10-keke | 11 | 44 | 80 | 93 | 0.1 |
| 969206 | kk-d10-keke | 33 | 59 | 81 | 92 | 0.04 |
| 969226 | kk-d8-eeeekk | 0 | 30 | 61 | 87 | 0.2 |
| 969316 | kk-d9-eeekk | 10 | 49 | 79 | 93 | 0.1 |
| 969336 | kk-d9-eeekk | 20 | 35 | 65 | 85 | 0.1 |
| 969406 | kk-d9-ekeke | 25 | 53 | 79 | 91 | 0.1 |
| 972046 | kkk-d8-kekek | 26 | 46 | 68 | 88 | 0.1 |
| 972096 | kkk-d9-keke | 24 | 66 | 89 | 95 | 0.04 |
| 972116 | kkk-d9-keke | 35 | 72 | 90 | 95 | 0.03 |
| 972166 | kkk-d9-kkke | 17 | 48 | 72 | 88 | 0.1 |
| 972176 | kkk-d9-kkke | 21 | 56 | 85 | 93 | 0.1 |
| 972186 | kkk-d9-kkke | 36 | 70 | 92 | 96 | 0.02 |
| 972196 | kkk-d9-kkke | 33 | 73 | 90 | 92 | 0.03 |

TABLE 61

Multi-dose assay with deoxy, MOE, and cEt gapmers

| Compound Number | Chemistry | 15.6 nM | 62.5 nM | 250 nM | 1,000 nM | $IC_{50}$ (μM) |
|---|---|---|---|---|---|---|
| 904082 | kkk-d10-kkk | 38 | 62 | 87 | 93 | 0.03 |
| 905095 | kkk-d10-kkk | 63 | 93 | 98 | 99 | <0.01 |
| 969087 | k-d10-kekek | 0 | 52 | 79 | 91 | 0.1 |
| 969127 | k-d9-kekeke | 0 | 46 | 78 | 90 | 0.1 |
| 969187 | kk-d10-keke | 17 | 38 | 75 | 86 | 0.1 |
| 969207 | kk-d10-keke | 36 | 46 | 78 | 91 | 0.1 |
| 969217 | kk-d10-keke | 14 | 41 | 74 | 92 | 0.1 |
| 969337 | kk-d9-eeekk | 35 | 62 | 81 | 92 | 0.03 |
| 969347 | kk-d9-eeekk | 38 | 72 | 91 | 96 | 0.02 |
| 969377 | kk-d9-eeekk | 41 | 68 | 85 | 91 | 0.02 |
| 969437 | kk-d9-ekeke | 40 | 78 | 92 | 97 | 0.02 |
| 969457 | kk-d9-ekeke | 36 | 65 | 83 | 92 | 0.03 |
| 969467 | kk-d9-ekeke | 20 | 58 | 84 | 92 | 0.1 |
| 971967 | kk-d9-kekek | 20 | 41 | 75 | 90 | 0.1 |
| 971997 | kkk-d8-kdkdk | 40 | 66 | 85 | 93 | 0.02 |
| 972027 | kkk-d8-kekek | 17 | 61 | 80 | 89 | 0.1 |
| 972097 | kkk-d9-keke | 21 | 67 | 89 | 97 | 0.05 |
| 972147 | kkk-d9-kkke | 34 | 61 | 83 | 92 | 0.04 |
| 972197 | kkk-d9-kkke | 43 | 69 | 88 | 94 | 0.02 |

TABLE 62

Multi-dose assay with deoxy, MOE, and cEt gapmers

| Compound Number | Chemistry | 15.6 nM | 62.5 nM | 250 nM | 1,000 nM | $IC_{50}$ (μM) |
|---|---|---|---|---|---|---|
| 904619 | kkk-d10-kkk | 24 | 50 | 84 | 93 | 0.1 |
| 905095 | kkk-d10-kkk | 74 | 94 | 99 | 100 | <0.01 |
| 969158 | kek-d9-eekk | 31 | 40 | 70 | 89 | 0.1 |
| 969167 | kek-d9-eekk | 14 | 43 | 64 | 84 | 0.1 |
| 969178 | kk-d10-keke | 27 | 56 | 80 | 93 | 0.1 |
| 969198 | kk-d10-keke | 31 | 53 | 79 | 92 | 0.1 |
| 969318 | kk-d9-eeekk | 37 | 78 | 94 | 98 | 0.02 |
| 969358 | kk-d9-eeekk | 28 | 61 | 86 | 96 | 0.04 |
| 969368 | kk-d9-eeekk | 39 | 72 | 91 | 97 | 0.02 |
| 969388 | kk-d9-eeekk | 18 | 51 | 79 | 91 | 0.1 |
| 969407 | kk-d9-ekeke | 8 | 30 | 61 | 86 | 0.2 |
| 969408 | kk-d9-ekeke | 36 | 66 | 90 | 96 | 0.03 |
| 969428 | kk-d9-ekeke | 40 | 41 | 71 | 90 | 0.1 |
| 969448 | kk-d9-ekeke | 33 | 61 | 86 | 96 | 0.04 |
| 969458 | kk-d9-ekeke | 19 | 40 | 74 | 92 | 0.1 |
| 969477 | kk-d9-kdkdk | 16 | 34 | 72 | 85 | 0.1 |
| 969497 | kk-d9-kdkdk | 3 | 28 | 59 | 75 | 0.2 |
| 971987 | kkk-d10-kkk | 8 | 17 | 51 | 80 | 0.2 |
| 972178 | kkk-d9-kkke | 19 | 54 | 78 | 91 | 0.1 |

TABLE 63

Multi-dose assay with deoxy, MOE, and cEt gapmers

| Compound Number | Chemistry | 15.6 nM | 62.5 nM | 250 nM | 1,000 nM | $IC_{50}$ (μM) |
|---|---|---|---|---|---|---|
| 905095 | kkk-d10-kkk | 65 | 94 | 99 | 99 | <0.01 |
| 969159 | kek-d9-eekk | 21 | 46 | 84 | 96 | 0.1 |
| 969169 | kek-d9-eekk | 22 | 41 | 69 | 89 | 0.1 |
| 969208 | kk-d10-keke | 25 | 53 | 84 | 89 | 0.1 |
| 969219 | kk-d10-keke | 16 | 35 | 66 | 87 | 0.1 |
| 969289 | kk-d8-kekekk | 3 | 36 | 70 | 88 | 0.1 |
| 969328 | kk-d9-eeekk | 19 | 40 | 61 | 85 | 0.1 |
| 969338 | kk-d9-eeekk | 13 | 34 | 72 | 90 | 0.1 |
| 969359 | kk-d9-eeekk | 24 | 61 | 84 | 93 | 0.05 |
| 969389 | kk-d9-eeekk | 20 | 42 | 77 | 92 | 0.1 |
| 969398 | kk-d9-ekeke | 14 | 41 | 62 | 86 | 0.1 |
| 969449 | kk-d9-ekeke | 43 | 64 | 83 | 92 | 0.02 |
| 969469 | kk-d9-kdkdk | 25 | 63 | 83 | 94 | 0.05 |
| 969479 | kk-d9-kdkdk | 40 | 71 | 91 | 96 | 0.02 |
| 969498 | kk-d9-kdkdk | 10 | 40 | 71 | 87 | 0.1 |
| 969508 | kk-d9-kdkdk | 17 | 34 | 70 | 88 | 0.1 |
| 971969 | kk-d9-kekek | 28 | 63 | 86 | 92 | 0.04 |
| 972118 | kkk-d9-keke | 10 | 42 | 70 | 87 | 0.1 |
| 972139 | kkk-d9-kkke | 35 | 69 | 88 | 96 | 0.03 |

TABLE 64

Multi-dose assay with deoxy, MOE, and cEt gapmers

| Compound Number | Chemistry | 15.6 nM | 62.5 nM | 250 nM | 1,000 nM | $IC_{50}$ (μM) |
|---|---|---|---|---|---|---|
| 905095 | kkk-d10-kkk | 68 | 93 | 99 | 99 | <0.01 |
| 969160 | kek-d9-eekk | 39 | 73 | 92 | 96 | 0.02 |
| 969180 | kk-d10-keke | 7 | 38 | 74 | 92 | 0.10 |
| 969210 | kk-d10-keke | 59 | 89 | 97 | 99 | <0.01 |
| 969229 | kk-d8-eeeekk | 4 | 23 | 80 | 91 | 0.10 |
| 969340 | kk-d9-eeekk | 23 | 60 | 87 | 98 | 0.05 |
| 969350 | kk-d9-eeekk | 12 | 46 | 74 | 92 | 0.10 |
| 969380 | kk-d9-eeekk | 27 | 59 | 84 | 93 | 0.05 |
| 969409 | kk-d9-ekeke | 22 | 48 | 80 | 93 | 0.10 |
| 969419 | kk-d9-ekeke | 8 | 25 | 58 | 84 | 0.20 |
| 969429 | kk-d9-ekeke | 17 | 41 | 71 | 85 | 0.10 |
| 969430 | kk-d9-ekeke | 29 | 59 | 83 | 96 | 0.05 |
| 969440 | kk-d9-ekeke | 29 | 60 | 82 | 95 | 0.04 |
| 972069 | kkk-d8-kekek | 25 | 55 | 84 | 93 | 0.10 |
| 972119 | kkk-d9-keke | 15 | 41 | 73 | 83 | 0.10 |
| 972120 | kkk-d9-keke | 32 | 65 | 88 | 96 | 0.03 |
| 972129 | kkk-d9-keke | 9 | 42 | 75 | 85 | 0.10 |
| 972189 | kkk-d9-kkke | 32 | 63 | 84 | 91 | 0.04 |
| 972190 | kkk-d9-kkke | 38 | 71 | 93 | 98 | 0.02 |

Example 3: Tolerability of Modified Oligonucleotides Targeting Human APOL1 in BALB/c Mice BALB/c mice are a multipurpose mouse model frequently utilized for safety and efficacy testing. The mice were treated with antisense oligonucleotides selected from studies described above and evaluated for changes in the levels of various plasma chemistry markers.

Treatment

Groups of 6- to 7-week-old male mice were injected subcutaneously once with 200 mg/kg of modified oligonucleotides. One group of male BALB/c mice was injected with PBS. Mice were euthanized 72-96 hours after the single dose and plasma was harvested for further analysis.

Study 1

To evaluate the effect of modified oligonucleotides on liver function, plasma levels of transaminases were measured using an automated clinical chemistry analyzer (Beckman Coulter AU480, Brea, CA). Modified oligonucleotides that caused changes in the levels of transaminases outside the expected range for antisense oligonucleotides were excluded in further studies. Compound IDs 793406, 903807, 903822, 903853, 904016, 904063, 904082, 904084, 904101, 904212, 904223, 904224, 904226, 904424, 904426, 904443, 904444, 904619, 904627, 904628, 904763, 904766, 905031, 905032, 905036, 905095, 905121, 905123, 905139, 905141, 905143, 905146, 905147, 905269, 905373, 905408, 905418, 905469, 905471, 905491, 905496, 905505, 905510, 905511, 905521, 905581, 905582, 905633, 905634, 905636, 905654, 905655, 905665, 905684, 905688, 905690, 905697, 905700, 905758 and 905867 were considered tolerable in this study and were selected for further evaluation.

Study 2

In a second study to evaluate the effect of modified oligonucleotides on liver function, plasma levels of transaminases were measured using an automated clinical chemistry analyzer (Beckman Coulter AU480, Brea, CA). Modified oligonucleotides that caused changes in the levels of transaminases outside the expected range for antisense oligonucleotides were excluded in further studies. Compound IDs 969157, 969160, 969162, 969210, 969214, 969231, 969318, 969347, 969361, 969362, 969408, 969433, 969437, 969479, 969501, 969502, 971925, 971973, 971997, 972002, 972116, 972139, 972163, 972190, 972268, and 972288 were considered tolerable in this study and were selected for further evaluation.

Example 4: Effect of Antisense Inhibition of hAPOL1 in a Transgenic Mouse Model

A transgenic mouse model was developed using the Fosmid ABC12-49114000M18, digested to produce a 31.6 Kb fragment containing only the APOL1 gene with 5 Kb upstream and 12 Kb downstream of the gene. The gene fragment was inserted into eggs from C57BL/6NTAc mice by pronuclear injection to produce two founder lines. Line 1 was used for the experiments described herein. Human APOL1 transcript is predominantly detectable in the liver, with hAPOL1 protein robustly detectable in the plasma of these mice. The efficacy of modified oligonucleotides was evaluated in this model.

Transgenic mice were maintained on a 12-hour light/dark cycle and were fed ad libitum normal Purina mouse chow. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in PBS for injection.

Study 1

The hAPOL1 transgenic mice were divided into groups of 2-4 mice each. Groups received subcutaneous injections of modified oligonucleotide at a dose of 25 mg/kg three times a week for one week, 3 total doses. One group of mice received subcutaneous injections of control oligonucleotide 549148 (GGCTACTACGCCGTCA, designated SEQ ID NO: 1948; a 3-10-3 cEt gapmer with no known target) at a dose of 25 mg/kg three times a week for one week, 3 total doses. One group of mice received subcutaneous injections of PBS three times per week for one week. The saline-injected group served as the control group to which oligonucleotide-treated groups were compared.

On day 7, animals were sacrificed and RNA was extracted from kidney and liver for real-time PCR analysis of hAPOL1 mRNA expression. Results are presented as percent change of mRNA, relative to PBS control, normalized with RIBOGREEN®. Two separate experiments were conducted with similar conditions and are presented in separate tables. As shown in the tables below, treatment with antisense oligonucleotides resulted in significant reduction of hAPO1 mRNA in comparison to the PBS control.

TABLE 65

Percent inhibition of APOL1 by 3-10-3 cEt gapmers in transgenic mice relative to the PBS control

| Compound ID | % Inhibition (liver) | % inhibition (kidney) |
|---|---|---|
| 549148 | 15 | 5 |
| 793406 | 83 | 29 |
| 903853 | 82 | 37 |
| 904016 | 64 | 21 |
| 904063 | 49 | 0 |
| 904082 | 93 | 46 |
| 904212 | 69 | 24 |
| 904223 | 66 | 10 |
| 904224 | 65 | 15 |
| 904226 | 89 | 28 |
| 904424 | 59 | 13 |
| 904426 | 43 | 27 |
| 904443 | 75 | 16 |
| 904444 | 65 | 26 |
| 904627 | 96 | 50 |
| 904628 | 77 | 43 |
| 905031 | 86 | 15 |
| 905032 | 92 | 38 |
| 905036 | 80 | 23 |
| 905141 | 90 | 1 |
| 905143 | 75 | 0 |
| 905146 | 76 | 20 |
| 905147 | 79 | 0 |
| 905269 | 54 | 8 |
| 905373 | 86 | 46 |
| 905408 | 78 | 10 |
| 905418 | 67 | 20 |
| 905471 | 87 | 32 |
| 905496 | 71 | 21 |
| 905505 | 95 | 16 |
| 905511 | 92 | 40 |
| 905521 | 86 | 31 |
| 905581 | 55 | 6 |
| 905582 | 51 | 0 |
| 905633 | 79 | 32 |
| 905636 | 22 | 0 |
| 905655 | 63 | 18 |
| 905688 | 81 | 3 |
| 905690 | 74 | 21 |
| 905697 | 81 | 7 |
| 905758 | 85 | 44 |
| 905867 | 83 | 31 |

TABLE 66

Percent inhibition of APOL1 by 3-10-3 cEt gapmers in transgenic mice relative to the PBS control

| Compound ID | % Inhibition (liver) | % inhibition (kidney) |
|---|---|---|
| 549148 | 10 | 7 |
| 793406 | 73 | 37 |
| 903807 | 51 | 32 |
| 903822 | 93 | 50 |
| 904084 | 87 | 43 |
| 904619 | 86 | 48 |
| 904763 | 88 | 56 |
| 904766 | 82 | 65 |
| 905095 | 92 | 69 |
| 904101 | 58 | 47 |
| 905121 | 93 | 66 |
| 905123 | 74 | 49 |
| 905139 | 87 | 51 |
| 905469 | 83 | 56 |
| 905491 | 95 | 69 |
| 905510 | 95 | 61 |
| 905634 | 60 | 46 |
| 905654 | 53 | 40 |

TABLE 66-continued

Percent inhibition of APOL1 by 3-10-3 cEt gapmers in transgenic mice relative to the PBS control

| Compound ID | % Inhibition (liver) | % inhibition (kidney) |
|---|---|---|
| 905665 | 85 | 47 |
| 905684 | 52 | 33 |
| 905700 | 79 | 45 |

Study 2

The hAPOL1 transgenic mice were divided into groups of 4 mice each. Groups received subcutaneous injections of modified oligonucleotide at a dose of 25 mg/kg twice a week for 1 weeks for 3 total doses. One group of mice received subcutaneous injections of control oligonucleotide 549148 at a dose of 25 mg/kg three times a week for one week, 3 total doses. One group of mice received subcutaneous injections of PBS three times a week for 1 week. The saline-injected group served as the control group to which oligonucleotide-treated groups were compared.

On day 7, animals were sacrificed and RNA was extracted from kidney and liver for real-time PCR analysis of measurement of hAPOL1 mRNA expression. Results are presented as percent change of mRNA, relative to PBS control, normalized with RIBOGREEN®. As shown in the tables below, treatment with antisense oligonucleotides resulted in significant reduction of hAPO1 mRNA in comparison to the PBS control.

TABLE 67

Percent inhibition of APOL1 by gapmers in transgenic mice relative to the PBS control

| Compound ID | Chemistry | Inhibition % (liver) | inhibition % (kidney) |
|---|---|---|---|
| 549148 | kkk-d10-kkk | 2 | 0 |
| 793406 | kkk-d10-kkk | 88 | 32 |
| 969157 | kek-d9-eekk | 85 | 41 |
| 969160 | kek-d9-eekk | 78 | 41 |
| 969162 | kek-d9-eekk | 92 | 56 |
| 969210 | kk-10-keke | 88 | 35 |
| 969214 | kk-d10-keke | 89 | 45 |
| 969231 | kk-d8-eeeekk | 57 | 29 |
| 969318 | kk-d9-eeekk | 64 | 17 |
| 969347 | kk-d9-eeekk | 75 | 22 |
| 969361 | kk-9-eeekk | 61 | 38 |
| 969362 | kk-d9-eeekk | 74 | 21 |
| 969408 | kk-d9-ekeke | 84 | 40 |
| 969433 | kk-d9-ekeke | 84 | 37 |
| 969437 | kk-d9-ekeke | 94 | 44 |
| 969479 | kk-d9-kdkdk | 74 | 23 |
| 969501 | kk-d9-kdkdk | 80 | 30 |
| 969502 | kk-9-kdkdk | 83 | 43 |
| 971925 | kk-d9-kekek | 78 | 39 |
| 971973 | kk-d9-kekek | 82 | 26 |
| 971997 | kkk-d8-kdkdk | 76 | 36 |
| 972002 | kkk-d8-kdkdk | 81 | 54 |
| 972116 | kkk-d9-keke | 80 | 46 |
| 972139 | kkk-d9-kkke | 88 | 56 |
| 972163 | kkk-d9-kkke | 91 | 52 |
| 972190 | kkk-d9-kkke | 90 | 46 |
| 972268 | kkk-d10-kkk | 50 | 46 |
| 972288 | kkk-d10-kkk | 64 | 28 |

Study 3: Effect of Antisense Inhibition of APOL1 on Mice with Proteinuria hAPOL1 transgenic mice were divided into groups of 3-4 mice each. Groups received subcutaneous injections of modified oligonucleotide 972190 at a dose of 50 mg/kg once a week for 4 weeks. One group of mice received subcutaneous injections of control oligonucleotide 549148 at a dose of 50 mg/kg once a week for 4 weeks. One group of mice received subcutaneous injections of PBS once a week for 4 weeks. A single dose of IFNγ was administered at $1.125 \times 10^7$ U/kg one day after the last oligonucleotide dose in order to induce proteinuria in the mice. The saline-injected group served as the control group to which oligonucleotide-treated groups were compared.

Urine was collected and the animals were sacrificed 48 hours after the IFNγ administration. RNA was extracted from kidney and liver for real-time PCR analysis of measurement of hAPOL1 mRNA expression. Results are presented as percent change of mRNA, relative to PBS control, normalized with RIBOGREEN®. As shown in the tables below, treatment with antisense oligonucleotides resulted in significant reduction of hAPO1 mRNA in comparison to the PBS control. As also shown in the tables below, treatment with 972190 resulted in significant reduction of urinary albumin and plasma ALT levels in comparison to control animals dosed with IFNγ. The results indicate that treatment with modified oligonucleotides targeting APOL1 protected APOL1 transgenic mice from proteinuria and reduced elevations in plasma ALT levels.

TABLE 68

Percent expression of APOL1 by gapmers in transgenic mice relative to PBS control

| Treatment | IFNγ treatment | Kidney | Liver |
|---|---|---|---|
| PBS | Yes | 179 | 120 |
| 549148 | No | 76 | 133 |
|  | Yes | 140 | 142 |
| 972190 | No | 41 | 7 |
|  | Yes | 47 | 3 |

TABLE 68

Effect of inhibition of APOL1 by gapmers in transgenic mice relative to the control

| Treatment | IFNγ treatment | Urinary albumin (μg/mg creatinine) | Plasma ALT (IU/L) |
|---|---|---|---|
| PBS | No | 41 | 163 |
|  | Yes | 727 | 211 |
| 549148 | No | 77 | 207 |
|  | Yes | 980 | 225 |
| 972190 | No | 56 | 63 |
|  | Yes | 50 | 61 |

Example 5: Tolerability of Modified Oligonucleotides Targeted to hAPOL1 in CD1 Mice CD1® mice (Charles River, MA) are a multipurpose mouse model, frequently utilized for safety and efficacy testing. The mice were treated with 3-10-3 cEt gapmer oligonucleotides selected from the studies described above and evaluated for changes in the levels of various plasma chemistry markers.

Treatment

Groups of 7-8-week-old male CD1 mice were injected subcutaneously twice a week for six weeks with 25 mg/kg of ISIS oligonucleotides (50 mg/kg/week dose). One group of male CD1 mice was injected subcutaneously twice a week for 6 weeks with PBS. Mice were euthanized 48 hours after the last dose, and organs and plasma were harvested for further analysis. Two separate studies were conducted with similar conditions and are presented in separate tables for each end-point analysis.

Study 1
Plasma Chemistry Markers

To evaluate the effect of ISIS oligonucleotides on liver and kidney function, plasma levels of transaminases, albumin, bilirubin, creatinine, and BUN were measured using an automated clinical chemistry analyzer (Beckman Coulter AU480, Brea, CA). The results are presented in the Table below. ISIS oligonucleotides that caused changes in the levels of any of the liver or kidney function markers outside the expected range for antisense oligonucleotides were excluded in further studies.

TABLE 68

Plasma chemistry markers in CD1 mice plasma at week 6

| Compound ID | ALT (IU/L) | AST (IU/L) | Albumin (g/dL) | BUN (mg/dL) | Creatinine (mg/dL) | T. Bil (mg/dL) |
|---|---|---|---|---|---|---|
| PBS | 26 | 43 | 2.7 | 21.3 | 0.05 | 0.3 |
| 793406 | 42 | 75 | 2.6 | 21.7 | 0.04 | 0.3 |
| 903853 | 413 | 470 | 2.5 | 22.8 | 0.06 | 0.3 |
| 904082 | 33 | 54 | 2.6 | 21.4 | 0.07 | 0.2 |
| 904226 | 40 | 74 | 2.4 | 21.1 | 0.05 | 0.2 |
| 904627 | 1122 | 1245 | 2.4 | 19.6 | 0.06 | 0.2 |
| 904628 | 41 | 75 | 2.5 | 22.5 | 0.02 | 0.2 |
| 905032 | 106 | 84 | 2.5 | 23.6 | 0.04 | 0.2 |
| 905373 | 81 | 88 | 2.4 | 22.4 | 0.05 | 0.1 |
| 905505 | 62 | 88 | 2.2 | 21.1 | 0.05 | 0.1 |
| 905511 | 303 | 159 | 2.2 | 20.3 | 0.05 | 0.1 |
| 905521 | 120 | 117 | 2.5 | 22.0 | 0.06 | 0.1 |
| 905633 | 31 | 40 | 2.5 | 23.1 | 0.06 | 0.1 |
| 905758 | 68 | 92 | 2.3 | 19.0 | 0.04 | 0.1 |
| 905867 | 168 | 199 | 2.3 | 24.0 | 0.03 | 0.1 |

Hematology Assays

Blood obtained from all mouse groups were sent to IDEXX BioResearch for hematocrit (HCT) measurements and analysis, as well as measurements of the various blood cells, such as WBC, RBC, lymphocytes, monocytes, and platelets. The results are presented in the tables below. ISIS oligonucleotides that caused changes in the levels of any of the hematology markers outside the expected range for antisense oligonucleotides were excluded in further studies.

TABLE 69

Hematology markers in CD1 mice

| Compound ID | HCT (%) | LYM ($10^3$/ μL) | MON ($10^3$/ μL) | PLT ($10^3$/ μL) | RBC ($10^6$/ μL) | WBC ($10^3$/ μL) |
|---|---|---|---|---|---|---|
| PBS | 43 | 4.4 | 0.2 | 1225 | 9.3 | 5.5 |
| 793406 | 44 | 5.7 | 0.4 | 892 | 9.6 | 7.5 |
| 903853 | 44 | 5.9 | 0.4 | 673 | 9.1 | 7.4 |
| 904082 | 41 | 5.4 | 0.3 | 1009 | 9.0 | 6.5 |
| 904226 | 41 | 4.3 | 0.3 | 624 | 9.2 | 5.2 |
| 904627 | 44 | 3.8 | 0.5 | 764 | 9.3 | 6.1 |
| 904628 | 42 | 2.7 | 0.1 | 765 | 9.2 | 4.0 |
| 905032 | 38 | 2.3 | 0.2 | 861 | 8.1 | 3.1 |
| 905373 | 42 | 4.7 | 0.4 | 922 | 8.8 | 6.1 |
| 905505 | 39 | 4.4 | 0.3 | 1252 | 8.3 | 6.1 |
| 905511 | 44 | 7.0 | 0.7 | 858 | 9.2 | 9.9 |
| 905521 | 42 | 3.1 | 0.3 | 734 | 8.8 | 4.1 |
| 905633 | 44 | 3.6 | 0.3 | 853 | 9.4 | 4.6 |
| 905758 | 40 | 3.2 | 0.3 | 628 | 8.5 | 4.0 |
| 905867 | 40 | 5.0 | 0.5 | 833 | 8.6 | 7.3 |

Study 2
Plasma Chemistry Markers

To evaluate the effect of ISIS oligonucleotides on liver and kidney function, plasma levels of transaminases, bilirubin, creatinine, and BUN were measured using an automated clinical chemistry analyzer (Hitachi Olympus AU400e, Melville, NY). The results are presented in the Table below. ISIS oligonucleotides that caused changes in the levels of any of the liver or kidney function markers outside the expected range for antisense oligonucleotides were excluded in further studies.

TABLE 70

Plasma chemistry markers in CD1 mice plasma at week 6

| Compound ID | ALT (IU/L) | AST (IU/L) | Albumin (g/dL) | BUN (mg/dL) | Creatinine (mg/dL) | T. Bil (mg/dL) |
|---|---|---|---|---|---|---|
| PBS | 248 | 213 | 2.7 | 21.3 | 0.11 | 0.19 |
| 793444 | 51 | 73 | 2.4 | 23.4 | 0.11 | 0.14 |
| 903822 | 68 | 171 | 2.6 | 23.8 | 0.13 | 0.15 |
| 904101 | 39 | 62 | 2.5 | 19.5 | 0.10 | 0.15 |
| 904619 | 590 | 466 | 2.1 | 17.2 | 0.06 | 0.14 |
| 904763 | 90 | 87 | 2.5 | 24.0 | 0.08 | 0.16 |
| 904766 | 297 | 262 | 2.3 | 19.3 | 0.07 | 0.16 |
| 905095 | 246 | 294 | 2.2 | 18.5 | 0.07 | 0.19 |
| 905139 | 92 | 95 | 2.4 | 18.3 | 0.09 | 0.16 |
| 905469 | 60 | 72 | 2.5 | 19.1 | 0.10 | 0.17 |
| 905491 | 972 | 989 | 1.9 | 22.4 | 0.06 | 0.20 |
| 905634 | 42 | 71 | 2.3 | 17.1 | 0.08 | 0.13 |
| 905665 | 182 | 118 | 2.1 | 20.8 | 0.07 | 0.13 |

Hematology Assays

Blood obtained from all mouse groups were sent to IDEXX BioResearch for hematocrit (HCT) measurements and analysis, as well as measurements of the various blood cells, such as WBC, RBC, lymphocytes, monocytes, and platelets. The results are presented in the tables below. ISIS oligonucleotides that caused changes in the levels of any of the hematology markers outside the expected range for antisense oligonucleotides were excluded in further studies.

TABLE 71

Hematology markers in CD1 mice

| Compound ID | HCT (%) | LYM ($10^3$/ μL) | MON ($10^3$/ μL) | PLT ($10^3$/ μL) | RBC ($10^6$/ μL) | WBC ($10^3$/ μL) |
|---|---|---|---|---|---|---|
| PBS | 50 | 2.8 | 0.3 | 824 | 10.7 | 6.2 |
| 793444 | 46 | 3.0 | 0.2 | 831 | 10.5 | 4.0 |
| 903822 | 44 | 4.0 | 0.2 | 525 | 10.1 | 5.4 |
| 904101 | 47 | 7.7 | 0.9 | 733 | 10.3 | 10.9 |
| 904619 | 42 | 21.0 | 1.2 | 686 | 9.5 | 26.5 |
| 904763 | 49 | 3.5 | 0.2 | 950 | 11.2 | 4.3 |
| 904766 | 51 | 7.9 | 0.9 | 603 | 11.5 | 10.3 |
| 905095 | 46 | 8.2 | 0.7 | 645 | 10.2 | 11.2 |
| 905139 | 49 | 4.2 | 0.4 | 997 | 10.7 | 6.2 |
| 905469 | 52 | 4.2 | 0.2 | 614 | 11.8 | 5.4 |
| 905491 | 43 | 7.8 | 2.4 | 495 | 9.6 | 23.1 |
| 905634 | 43 | 3.2 | 0.3 | 716 | 9.6 | 4.2 |
| 905665 | 41 | 4.7 | 0.3 | 686 | 8.6 | 6.6 |

Study 3
Body and Organ Weights

To evaluate the effect of ISIS oligonucleotides on animal health, body and organ weights measured at the end of the study. The results are presented in the Table below. ISIS oligonucleotides that caused changes in the levels of any of the weights outside the expected range for antisense oligonucleotides were excluded in further studies.

TABLE 72

Body and organ weights of CD1 mice plasma at week 6

| | Liver | Kidney | Spleen | Body weight |
|---|---|---|---|---|
| PBS | 2.1 | 0.6 | 0.1 | 41.6 |
| 969157 | 2.4 | 0.6 | 0.2 | 39.0 |
| 969160 | 2.2 | 0.5 | 0.2 | 36.7 |
| 969162 | 2.2 | 0.6 | 0.2 | 40.8 |
| 969210 | 2.2 | 0.6 | 0.2 | 41.0 |
| 969214 | 2.1 | 0.6 | 0.2 | 41.0 |
| 969361 | 2.2 | 0.5 | 0.2 | 40.3 |
| 969408 | 2.4 | 0.6 | 0.2 | 42.4 |
| 969433 | 2.6 | 0.6 | 0.2 | 43.3 |
| 969437 | 2.5 | 0.6 | 0.2 | 41.3 |
| 969502 | 2.4 | 0.6 | 0.2 | 37.9 |
| 971925 | 2.5 | 0.7 | 0.2 | 41.5 |
| 971997 | 2.2 | 0.5 | 0.1 | 40.1 |
| 972002 | 2.7 | 0.5 | 0.2 | 40.4 |
| 972116 | 2.1 | 0.5 | 0.2 | 38.8 |
| 972139 | 2.4 | 0.5 | 0.2 | 40.3 |
| 972163 | 2.1 | 0.5 | 0.2 | 41.1 |
| 972190 | 2.3 | 0.6 | 0.1 | 41.0 |
| 972268 | 3.1 | 0.6 | 0.3 | 46.0 |

Plasma Chemistry Markers

To evaluate the effect of ISIS oligonucleotides on liver and kidney function, plasma levels of transaminases, albumin, bilirubin, creatinine, and BUN were measured using an automated clinical chemistry analyzer (Beckman Coulter AU480, Brea, CA). The results are presented in the Table below. ISIS oligonucleotides that caused changes in the levels of any of the liver or kidney function markers outside the expected range for antisense oligonucleotides were excluded in further studies.

TABLE 73

Plasma chemistry markers in CD1 mice plasma at week 6

| | ALT (IU/L) | AST (IU/L) | Albumin (g/dL) | BUN (mg/dL) | Creatinine (mg/dL) | T. Bil (mg/dL) |
|---|---|---|---|---|---|---|
| PBS | 31 | 77 | 3.1 | 26.4 | 0.2 | 0.2 |
| 969157 | 818 | 1083 | 2.9 | 23.2 | 0.2 | 0.3 |
| 969160 | 482 | 715 | 2.8 | 22.4 | 0.2 | 0.2 |
| 969162 | 68 | 141 | 2.6 | 21.5 | 0.1 | 0.2 |
| 969210 | 87 | 166 | 2.6 | 25.5 | 0.2 | 0.2 |
| 969214 | 456 | 502 | 2.6 | 23.9 | 0.1 | 0.2 |
| 969361 | 70 | 147 | 2.8 | 23.0 | 0.1 | 0.2 |
| 969408 | 76 | 138 | 2.6 | 23.3 | 0.1 | 0.1 |
| 969433 | 84 | 136 | 2.6 | 20.0 | 0.1 | 0.2 |
| 969437 | 240 | 281 | 2.4 | 21.5 | 0.1 | 0.1 |
| 969502 | 184 | 217 | 2.7 | 23.1 | 0.1 | 0.1 |
| 971925 | 114 | 168 | 2.8 | 23.6 | 0.1 | 0.2 |
| 971997 | 52 | 101 | 2.9 | 22.1 | 0.1 | 0.1 |
| 972002 | 147 | 192 | 2.5 | 21.2 | 0.1 | 0.1 |
| 972116 | 75 | 107 | 3.0 | 21.1 | 0.1 | 0.1 |
| 972139 | 61 | 115 | 2.7 | 22.2 | 0.1 | 0.1 |
| 972163 | 86 | 124 | 3.0 | 20.4 | 0.1 | 0.2 |
| 972190 | 70 | 93 | 2.8 | 20.5 | 0.1 | 0.2 |
| 972268 | 41 | 79 | 2.6 | 19.1 | 0.1 | 0.1 |

Hematology Assays

Blood obtained from all mouse groups were sent to IDEXX BioResearch for hematocrit (HCT) measurements and analysis, as well as measurements of the various blood cells, such as WBC, RBC, lymphocytes, monocytes, and platelets. The results are presented in the tables below. ISIS oligonucleotides that caused changes in the levels of any of the hematology markers outside the expected range for antisense oligonucleotides were excluded in further studies.

TABLE 74

Hematology markers in CD1 mice

| | Neutrophil (%) | WBC (K/µL) | RBC (M/µL) | Lymphocytes (%) | HCT (%) | Platelet Count (K/µL) | Lymphocytes (/µL) | Monocytes (/µL) |
|---|---|---|---|---|---|---|---|---|
| PBS | 16 | 4 | 10 | 54 | 47 | 1152 | 2185 | 144 |
| 969157 | 23 | 6 | 10 | 65 | 48 | 1338 | 4078 | 543 |
| 969160 | 20 | 13 | 10 | 69 | 46 | 974 | 7953 | 1425 |
| 696162 | 16 | 8 | 10 | 74 | 46 | 1002 | 6067 | 641 |
| 969210 | 20 | 7 | 10 | 70 | 48 | 920 | 5322 | 524 |
| 969214 | 17 | 5 | 10 | 69 | 44 | 1076 | 3781 | 687 |
| 969361 | 16 | 9 | 9 | 75 | 43 | 931 | 6617 | 599 |
| 969408 | 35 | 7 | 9 | 58 | 42 | 1069 | 4416 | 506 |
| 969433 | 25 | 6 | 10 | 70 | 46 | 1054 | 3900 | 182 |
| 969437 | 23 | 7 | 11 | 69 | 47 | 1316 | 4780 | 526 |
| 969502 | 14 | 8 | 10 | 75 | 44 | 1075 | 5845 | 651 |
| 971925 | 18 | 5 | 10 | 74 | 44 | 961 | 3529 | 312 |
| 971997 | 18 | 4 | 9 | 73 | 43 | 1216 | 2646 | 239 |
| 972002 | 27 | 7 | 9 | 67 | 41 | 1069 | 4781 | 286 |
| 972116 | 23 | 6 | 10 | 69 | 44 | 1141 | 4415 | 336 |
| 972139 | 19 | 5 | 9 | 77 | 37 | 877 | 3947 | 224 |
| 972163 | 10 | 6 | 10 | 81 | 43 | 925 | 5197 | 437 |
| 972190 | 15 | 7 | 10 | 77 | 47 | 1453 | 5281 | 400 |
| 972268 | 39 | 7 | 10 | 54 | 46 | 1468 | 3891 | 406 |

Example 6: Tolerability of Modified Oligonucleotides Targeted to hAPOL1 in Sprague-Dawley Rats Sprague-Dawley rats are a multipurpose model used for safety and efficacy evaluations. The rats were treated with 3-10-3 cEt gapmer oligonucleotides from the studies described in the Examples above and evaluated for changes in the levels of various plasma chemistry markers.

Treatment

Male Sprague-Dawley rats were maintained on a 12-hour light/dark cycle and fed ad libitum with Purina normal rat chow, diet 5001. Groups of 4 Sprague-Dawley rats each were injected subcutaneously once a week for 6 weeks with 50 mg/kg of ISIS oligonucleotide. Forty-eight hours after the last dose, rats were euthanized and organs and plasma were harvested for further analysis. Two separate studies were conducted with similar conditions.

Study 1

Liver Function

To evaluate the effect of ISIS oligonucleotides on hepatic function, plasma levels of transaminases were measured using an automated clinical chemistry analyzer (Hitachi Olympus AU400e, Melville, NY). Plasma levels of ALT (alanine transaminase) and AST (aspartate transaminase) were measured and the results are presented in the Table below expressed in IU/L. ISIS oligonucleotides that caused changes in the levels of any markers of liver function outside the expected range for antisense oligonucleotides were excluded in further studies.

TABLE 75

Liver function markers in Sprague-Dawley rats

| Compound ID | ALT (IU/L) | AST (IU/L) |
|---|---|---|
| PBS | 45 | 66 |
| 793406 | 31 | 56 |
| 904082 | 67 | 114 |
| 904226 | 125 | 251 |
| 904628 | 42 | 87 |
| 905032 | 195 | 293 |
| 905373 | 54 | 90 |
| 905505 | 66 | 94 |
| 905521 | 41 | 67 |
| 905633 | 83 | 114 |
| 905758 | 85 | 144 |

Kidney Function

To evaluate the effect of ISIS oligonucleotides on kidney function, plasma levels of blood urea nitrogen (BUN) and creatinine were measured using an automated clinical chemistry analyzer (Hitachi Olympus AU400e, Melville, NY). Results are presented in the Table below, expressed in mg/dL. ISIS oligonucleotides that caused changes in the levels of any of the kidney function markers outside the expected range for antisense oligonucleotides were excluded in further studies.

TABLE 76

Kidney function markers in Sprague-Dawley rats

| Compound ID | Albumin (g/dL) | BUN (mg/dL) | Creatinine (mg/dL) | T.Bil (mg/dL) |
|---|---|---|---|---|
| PBS | 3.7 | 16.0 | 0.3 | 0.2 |
| 793406 | 2.9 | 23.1 | 0.4 | 0.2 |
| 904082 | 4.0 | 27.0 | 0.4 | 0.2 |
| 904226 | 2.8 | 26.6 | 0.4 | 0.2 |
| 904628 | 3.2 | 18.9 | 0.4 | 0.1 |
| 905032 | 3.5 | 21.0 | 0.5 | 0.2 |
| 905373 | 3.1 | 19.9 | 0.4 | 0.1 |
| 905505 | 3.4 | 18.2 | 0.4 | 0.2 |
| 905521 | 1.9 | 78.0 | 1.1 | 0.1 |
| 905633 | 3.3 | 20.6 | 0.4 | 0.1 |
| 905758 | 3.1 | 37.5 | 0.4 | 0.2 |

Hematology Assays

Blood obtained from all rat groups were sent to Antech Diagnostics for hematocrit (HCT) measurements and analysis, as well as measurements of the various blood cells, such as WBC, RBC, and total hemoglobin content. The results are presented in the Table below. ISIS oligonucleotides that caused changes in the levels of any of the hematology markers outside the expected range for antisense oligonucleotides were excluded in further studies.

TABLE 77

Hematology markers in Sprague-Dawley rats

| Compound ID | HCT (%) | LYM ($10^3/\mu L$) | MON ($10^3/\mu L$) | EOS ($10^3/\mu L$) | BAS ($10^{3/L}$) | NEU ($10^{3/L}$) | RET ($10^3/L$) |
|---|---|---|---|---|---|---|---|
| PBS | 51 | 9 | 0.5 | 88 | 15 | 1.2 | 263 |
| 793406 | 47 | 14 | 2.1 | 101 | 53 | 3.3 | 156 |
| 904226 | 33 | 11 | 1.4 | 0 | 54 | 0.6 | 99 |
| 904628 | 42 | 21 | 3.0 | 18 | 167 | 1.3 | 176 |
| 905032 | 48 | 19 | 1.7 | 54 | 56 | 1.2 | 112 |
| 905373 | 43 | 19 | 1.4 | 18 | 49 | 0.9 | 216 |
| 905505 | 46 | 13 | 1.3 | 15 | 58 | 0.6 | 119 |
| 905521 | 44 | 11 | 1.3 | 17 | 24 | 2.5 | 37 |
| 905633 | 47 | 8 | 0.8 | 55 | 17 | 0.8 | 149 |
| 905758 | 50 | 24 | 3.7 | 37 | 74 | 2.1 | 128 |

TABLE 78

Hematology markers in Sprague-Dawley rats

| Compound ID | MCH (pg) | MCHC (g/dL) | MCV (fL) | PLT ($10^3/\mu L$) | HGB | RBC ($10^6/\mu L$) | WBC ($10^3/\mu L$) |
|---|---|---|---|---|---|---|---|
| PBS | 19 | 32 | 59 | 747 | 16 | 9 | 11 |
| 793406 | 18 | 33 | 55 | 625 | 15 | 9 | 20 |
| 904226 | 18 | 33 | 55 | 145 | 11 | 6 | 13 |
| 904628 | 18 | 32 | 55 | 220 | 13 | 8 | 26 |
| 905032 | 18 | 33 | 54 | 684 | 16 | 9 | 22 |
| 905373 | 17 | 32 | 55 | 619 | 14 | 8 | 21 |
| 905505 | 18 | 33 | 55 | 590 | 15 | 9 | 15 |
| 905521 | 17 | 34 | 52 | 799 | 15 | 9 | 15 |
| 905633 | 19 | 34 | 54 | 658 | 16 | 9 | 10 |
| 905758 | 18 | 33 | 53 | 559 | 17 | 10 | 30 |

Organ Weights

Liver, spleen and kidney weights were measured at the end of the study, and are presented in the Table below. ISIS oligonucleotides that caused any changes in organ weights outside the expected range for antisense oligonucleotides were excluded from further studies.

TABLE 79

Organ weights (g)

| Compound ID | Liver (g) | Kidney (g) | Spleen (g) |
|---|---|---|---|
| PBS | 14.8 | 2.7 | 0.8 |
| 793406 | 13.5 | 2.5 | 1.0 |
| 904082 | 13.8 | 3.6 | 1.7 |
| 904226 | 13.4 | 3.2 | 2.2 |
| 904628 | 15.6 | 2.7 | 3.2 |
| 905032 | 10.6 | 2.6 | 1.2 |
| 905373 | 14.7 | 2.4 | 1.9 |
| 905505 | 14.0 | 2.6 | 1.5 |
| 905521 | 11.7 | 3.4 | 0.8 |
| 905633 | 13.3 | 2.3 | 1.2 |
| 905758 | 12.9 | 2.7 | 2.1 |

Study 2

Liver Function

To evaluate the effect of ISIS oligonucleotides on hepatic function, plasma levels of transaminases were measured using an automated clinical chemistry analyzer (Hitachi Olympus AU400e, Melville, NY). Plasma levels of ALT (alanine transaminase) and AST (aspartate transaminase) were measured and the results are presented in the Table below expressed in IU/L. ISIS oligonucleotides that caused changes in the levels of any markers of liver function outside the expected range for antisense oligonucleotides were excluded in further studies.

TABLE 80

Liver function markers in Sprague-Dawley rats

| Compound ID | ALT (IU/L) | AST (IU/L) |
|---|---|---|
| PBS | 44 | 65 |
| 793444 | 59 | 89 |
| 903822 | 46 | 148 |
| 904101 | 55 | 89 |
| 904763 | 66 | 96 |
| 905139 | 212 | 447 |
| 905469 | 41 | 78 |
| 905634 | 135 | 112 |
| 905665 | 82 | 105 |

Kidney Function

To evaluate the effect of ISIS oligonucleotides on kidney function, plasma levels of blood urea nitrogen (BUN) and creatinine were measured using an automated clinical chemistry analyzer (Hitachi Olympus AU400e, Melville, NY). Results are presented in the Table below, expressed in mg/dL. ISIS oligonucleotides that caused changes in the levels of any of the kidney function markers outside the expected range for antisense oligonucleotides were excluded in further studies.

TABLE 81

Kidney function markers in Sprague-Dawley rats

| Compound ID | Albumin (g/dL) | BUN (mg/dL) | Creatinine (mg/dL) | T.Bil (mg/dL) |
|---|---|---|---|---|
| PBS | 3.5 | 17.5 | 0.3 | 0.2 |
| 793444 | 3.3 | 18.7 | 0.3 | 0.2 |
| 903822 | 3.0 | 16.7 | 0.3 | 0.3 |
| 904101 | 3.5 | 21.4 | 0.4 | 0.2 |
| 904763 | 3.4 | 19.1 | 0.4 | 0.2 |
| 905139 | 4.0 | 21.0 | 0.4 | 2.5 |
| 905469 | 3.4 | 16.7 | 0.3 | 0.1 |
| 905634 | 3.5 | 19.3 | 0.4 | 0.2 |
| 905665 | 2.9 | 20.0 | 0.4 | 0.2 |

Hematology Assays

Blood obtained from all rat groups were sent to Antech Diagnostics for hematocrit (HCT) measurements and analysis, as well as measurements of the various blood cells, such as WBC, RBC, and total hemoglobin content. The results are presented in the Table below. ISIS oligonucleotides that caused changes in the levels of any of the hematology markers outside the expected range for antisense oligonucleotides were excluded in further studies. N.d. indicates that the parameter was not measured for that particular oligonucleotide.

TABLE 82

Hematology markers in Sprague-Dawley rats

| Compound ID | WBC (K/μL) | RBC (M/μL) | Lymphocyte (/μL) | HCT (%) | Monocyte (/μL) | Platelet Count (K/μL) |
|---|---|---|---|---|---|---|
| PBS | 11 | 8.4 | 7781 | 53 | 30 | 687 |
| 793444 | 16 | 9.5 | n.d. | 55 | n.d. | 559 |
| 903822 | 13 | 6.5 | 12446 | 40 | 462 | 670 |
| 904101 | 13 | 8.7 | 11510 | 51 | 35 | 680 |
| 904763 | 10 | 8.3 | 8612 | 49 | n.d. | 785 |
| 905139 | 20 | 7.9 | 14922 | 46 | 274 | 769 |
| 905469 | 12 | 7.8 | n.d. | 49 | n.d. | 592 |
| 905634 | 12 | 8.6 | 10853 | 51 | 0 | 668 |
| 905665 | 13 | 9.1 | 6794 | 56 | 79 | 814 |

Organ Weights

Liver, spleen and kidney weights were measured at the end of the study, and are presented in the Table below. ISIS oligonucleotides that caused any changes in organ weights outside the expected range for antisense oligonucleotides were excluded from further studies.

TABLE 83

Organ weights (g)

| Compound ID | Liver (g) | Kidney (g) | Spleen (g) |
|---|---|---|---|
| PBS | 18.7 | 3.0 | 0.9 |
| 793444 | 13.4 | 2.7 | 1.0 |
| 903822 | 16.0 | 3.2 | 2.9 |
| 904101 | 16.6 | 2.9 | 1.4 |
| 904763 | 18.0 | 2.6 | 1.2 |
| 905139 | 16.9 | 3.4 | 1.9 |
| 905469 | 18.4 | 2.9 | 1.9 |
| 905634 | 20.3 | 2.8 | 1.4 |
| 905665 | 16.5 | 3.0 | 1.4 |

Study 3

Liver Function

To evaluate the effect of ISIS oligonucleotides on hepatic function, plasma levels of transaminases were measured using an automated clinical chemistry analyzer (Hitachi Olympus AU400e, Melville, NY). Plasma levels of ALT (alanine transaminase) and AST (aspartate transaminase) were measured and the results are presented in the Table below expressed in IU/L. ISIS oligonucleotides that caused changes in the levels of any markers of liver function outside the expected range for antisense oligonucleotides were excluded in further studies.

TABLE 84

Liver function markers in Sprague-Dawley rats

| | ALT (IU/L) | AST (IU/L) | Bilirubin (mg/dL) |
|---|---|---|---|
| PBS | 34 | 58 | 0.2 |
| 969162 | 41 | 119 | 0.2 |
| 972139 | 35 | 94 | 0.2 |
| 972002 | 41 | 83 | 0.2 |
| 972163 | 37 | 81 | 0.2 |
| 972116 | 31 | 59 | 0.1 |
| 972190 | 62 | 93 | 0.1 |
| 972268 | 336 | 286 | 0.8 |
| 969408 | 104 | 132 | 0.2 |
| 969361 | 240 | 386 | 0.4 |
| 969433 | 31 | 99 | 0.1 |

TABLE 84-continued

Liver function markers in Sprague-Dawley rats

|  | ALT (IU/L) | AST (IU/L) | Bilirubin (mg/dL) |
|---|---|---|---|
| 971997 | 50 | 84 | 0.2 |
| 969210 | 32 | 87 | 0.2 |

Kidney Function

To evaluate the effect of ISIS oligonucleotides on kidney function, plasma levels of blood urea nitrogen (BUN) and creatinine were measured using an automated clinical chemistry analyzer (Hitachi Olympus AU400e, Melville, NY). Results are presented in the Table below, expressed in mg/dl. ISIS oligonucleotides that caused changes in the levels of any of the kidney function markers outside the expected range for antisense oligonucleotides were excluded in further studies.

TABLE 85

Plasma levels for kidney markers in Sprague-Dawley rats

|  | BUN (mg/dL) | Creatinine (mg/dL) | Albumin (g/dL) |
|---|---|---|---|
| PBS | 17 | 0.2 | 3.3 |
| 969162 | 21 | 0.3 | 2.8 |
| 972139 | 67 | 0.8 | 2.8 |
| 972002 | 23 | 0.3 | 2.7 |
| 972163 | 19 | 0.3 | 2.9 |
| 972116 | 19 | 0.3 | 2.9 |
| 972190 | 19 | 0.3 | 3.0 |
| 972268 | 16 | 0.3 | 3.0 |
| 969408 | 19 | 0.3 | 3.2 |
| 969361 | 24 | 0.4 | 2.8 |
| 969433 | 21 | 0.3 | 2.7 |
| 971997 | 21 | 0.3 | 2.9 |
| 969210 | 19 | 0.3 | 3.1 |

TABLE 86

Urine levels for kidney markers in Sprague-Dawley rats

|  | Creatinine (mg/dL) | Protein (mg/dL) | Protein/Creatinine ratio |
|---|---|---|---|
| PBS | 121 | 113 | 1.0 |
| 969162 | 101 | 452 | 4.2 |
| 972139 | 61 | 283 | 4.0 |
| 972002 | 110 | 895 | 7.4 |
| 972163 | 96 | 394 | 4.0 |
| 972116 | 105 | 405 | 3.8 |
| 972190 | 109 | 261 | 2.4 |
| 972268 | 52 | 214 | 4.1 |
| 969408 | 51 | 147 | 3.0 |
| 969361 | 48 | 255 | 5.2 |
| 969433 | 51 | 224 | 4.3 |
| 971997 | 67 | 268 | 4.3 |
| 969210 | 86 | 338 | 3.9 |

Hematology Assays

Blood obtained from all rat groups were sent to Antech Diagnostics for hematocrit (HCT) measurements and analysis, as well as measurements of the various blood cells, such as WBC, RBC, and total hemoglobin content. The results are presented in the Table below. ISIS oligonucleotides that caused changes in the levels of any of the hematology markers outside the expected range for antisense oligonucleotides were excluded in further studies. N.d. indicates that the parameter was not measured for that particular oligonucleotide.

TABLE 87

Hematology markers in Sprague-Dawley rats

| Compound ID | WBC (K/µL) | RBC (M/µL) | Lymphocyte (/µL) | HCT (%) | Monocyte (/µL) | Platelet Count (K/µL) |
|---|---|---|---|---|---|---|
| PBS | 8 | 9 | 7035 | 51 | 252 | 725 |
| 969162 | 23 | 6 | 20273 | 36 | 2219 | 144 |
| 972139 | 20 | 6 | 16184 | 34 | 2500 | 427 |
| 972002 | 18 | 7 | 13972 | 43 | 1946 | 547 |
| 972163 | 25 | 8 | 22377 | 43 | 2302 | 556 |
| 972116 | 26 | 7 | 22581 | 42 | 1973 | 325 |
| 972190 | 9 | 8 | 8171 | 48 | 791 | 703 |
| 972268 | 20 | 8 | 16780 | 48 | 2237 | 737 |
| 969408 | 15 | 8 | 11733 | 46 | 1840 | 685 |
| 969361 | 32 | 7 | 25970 | 43 | 4802 | 230 |
| 969433 | 22 | 5 | 17649 | 31 | 2434 | 112 |
| 971997 | 24 | 7 | 20272 | 38 | 2077 | 458 |
| 969210 | 34 | 6 | 27724 | 37 | 3880 | 294 |

Organ Weights

Liver, spleen and kidney weights, as well as body weights, were measured at the end of the study, and are presented in the Table below. ISIS oligonucleotides that caused any changes in weights outside the expected range for antisense oligonucleotides were excluded from further studies.

TABLE 88

Weights (g)

|  | Liver | Kidney | Spleen | BW |
|---|---|---|---|---|
| PBS | 17 | 3.1 | 0.8 | 412 |
| 969162 | 17 | 3.3 | 3.3 | 358 |
| 972139 | 16 | 4.5 | 2.8 | 322 |
| 972002 | 24 | 3.8 | 2.5 | 365 |
| 972163 | 16 | 3.1 | 2.2 | 351 |
| 972116 | 17 | 3.5 | 2.8 | 357 |
| 972190 | 16 | 3.0 | 1.4 | 342 |
| 972268 | 17 | 2.9 | 1.4 | 355 |
| 969408 | 15 | 2.6 | 1.4 | 359 |
| 969361 | 17 | 2.6 | 2.9 | 344 |
| 969433 | 20 | 4.0 | 4.1 | 365 |
| 971997 | 16 | 2.6 | 2.3 | 355 |
| 969210 | 16 | 3.5 | 2.7 | 378 |

Example 7: Dose-Dependent Inhibition of hAPOL1 in Transgenic Mouse Model

Transgenic mice hAPOL1 mice, described above, were maintained on a 12-hour light/dark cycle and were fed ad libitum normal Purina mouse chow. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Study 1

The hAPOL1 transgenic mice were divided into groups of 4 mice each. Groups received subcutaneous injections of 3-10-3 cEt gapmers at a dose of 5, 15, or 50 mg/kg once a week for four weeks, 4 total doses, as indicated in the tables below. One group of mice received subcutaneous injections of PBS once a week for 4 weeks. The saline-injected group served as the control group to which oligonucleotide-treated groups were compared.

RNA Analysis

Mice were sacrificed 48 hours after the last dose and RNA was extracted from kidney and liver for real-time PCR analysis of measurement of mRNA expression of hAPOL1. Results are presented as percent change of mRNA, relative to PBS control, normalized with RIBOGREEN®. Two separate experiments were conducted with similar conditions and are presented in separate tables. As shown in the tables below, treatment with antisense oligonucleotides resulted in significant reduction of hAPO1 mRNA in comparison to the PBS control.

TABLE 89

Percent inhibition hAPOL1 mRNA in the transgenic mouse kidney relative to the PBS control (experiment 1)

| Compound ID | Weekly Dose 5 mg/kg | 15 mg/kg | 50 mg/kg | $ED_{50}$ (mg/kg/week) |
|---|---|---|---|---|
| | % Inhibition hAPOL1 | | | |
| 793406 | 0 | 20 | 35 | >50 |
| 793444 | 6 | 17 | 38 | >50 |
| 903822 | 1 | 21 | 32 | >50 |
| 904101 | 0 | 0 | 17 | >50 |
| 904763 | 7 | 20 | 49 | >50 |
| 905139 | 0 | 21 | 35 | >50 |
| 905469 | 11 | 25 | 50 | >50 |
| 905634 | 0 | 0 | 39 | >50 |
| 905665 | 0 | 23 | 39 | >50 |

TABLE 90

Percent inhibition hAPOL1 mRNA in the transgenic mouse liver relative to the PBS control (experiment 2)

| Compound ID | Weekly Dose 5 mg/kg | 15 mg/kg | 50 mg/kg | $ED_{50}$ (mg/kg/week) |
|---|---|---|---|---|
| | % Inhibition hAPOL | | | |
| 793406 | 6 | 68 | 92 | 11.8 |
| 793444 | 9 | 29 | 73 | 26.5 |
| 903822 | 24 | 78 | 95 | 8.5 |
| 904101 | 0 | 19 | 70 | 32.8 |
| 904763 | 36 | 83 | 92 | 6.8 |
| 905139 | 39 | 73 | 93 | 7.0 |
| 905469 | 39 | 75 | 96 | 9.3 |
| 905634 | 13 | 72 | 93 | 9.3 |
| 905665 | 2 | 71 | 92 | 10.5 |

Study 2

The hAPOL1 transgenic mice were divided into groups of 4 mice each. Groups received subcutaneous injections of 3-10-3 cEt gapmers at a dose of 5, 15, or 50 mg/kg once a week for four weeks, 4 total doses, as indicated in the tables below. One group of mice received subcutaneous injections of PBS once a week for 4 weeks. The saline-injected group served as the control group to which oligonucleotide-treated groups were compared.

RNA Analysis

Mice were sacrificed 48 hours after the last dose and RNA was extracted from kidney and liver for real-time PCR analysis of measurement of mRNA expression of hAPOL1. Results are presented as percent change of mRNA, relative to PBS control, normalized with RIBOGREEN®. Two separate experiments were conducted with similar conditions and are presented in separate tables. As shown in the tables below, treatment with antisense oligonucleotides resulted in significant reduction of hAPO1 mRNA in comparison to the PBS control.

TABLE 91

Percent inhibition hAPOL1 mRNA in the transgenic mouse kidney relative to the PBS control (experiment 1)

| Compound ID | Weekly Dose 5 mg/kg | 15 mg/kg | 50 mg/kg | ED50 (mg/kg/week) |
|---|---|---|---|---|
| | % Inhibition hAPOL1 | | | |
| 793406 | 22 | 42 | 51 | 40.6 |
| 904082 | 33 | 50 | 61 | 18.1 |
| 904226 | 17 | 36 | 59 | 31.7 |
| 904628 | 33 | 41 | 50 | >50 |
| 905032 | 22 | 15 | 45 | >50 |
| 905373 | 26 | 50 | 35 | >50 |
| 905505 | 22 | 52 | 57 | 23.6 |
| 905521 | 25 | 46 | 53 | 21.4 |
| 905633 | 18 | 16 | 48 | >50 |
| 905758 | 27 | 27 | 49 | >50 |

TABLE 92

Percent inhibition hAPOL1 mRNA in the transgenic mouse liver relative to the PBS control (experiment 2)

| Compound ID | Weekly Dose 5 mg/kg | 15 mg/kg | 50 mg/kg | $ED_{50}$ (mg/kg/week) |
|---|---|---|---|---|
| | % Inhibition hAPOL1 | | | |
| 793406 | 19 | 60 | 94 | 11.7 |
| 904082 | 54 | 81 | 94 | 4.4 |
| 904226 | 32 | 73 | 96 | 8.0 |
| 904628 | 57 | 70 | 91 | 3.7 |
| 905032 | 65 | 92 | 96 | 3.3 |
| 905373 | 39 | 84 | 35 | >50 |
| 905505 | 28 | 83 | 92 | 7.6 |
| 905521 | 0 | 68 | 95 | 12.3 |
| 905633 | 0 | 18 | 79 | 21.9 |
| 905758 | 0 | 60 | 81 | 11.8 |

Study 3

The hAPOL1 transgenic mice were divided into groups of 4 mice each. Groups received subcutaneous injections of modified oligonucleotide at a dose of 1.5, 5, 15, or 50 mg/kg once a week for four weeks, 4 total doses, as indicated in the tables below. One group of mice received subcutaneous injections of PBS once a week for 4 weeks. The saline-injected group served as the control group to which oligonucleotide-treated groups were compared.

RNA Analysis

Mice were sacrificed 48 hours after the last dose and RNA was extracted from kidney and liver for real-time PCR analysis of measurement of mRNA expression of hAPOL1. Results are presented as percent change of mRNA, relative to PBS control, normalized with RIBOGREEN®. As shown in the tables below, treatment with antisense oligonucleotides resulted in significant reduction of hAPO1 mRNA in comparison to the PBS control.

TABLE 93

Percent inhibition hAPOL1 mRNA in the transgenic mouse kidney relative to the PBS control

| Compound ID | Weekly Dose 1.5 mg/kg | 5 mg/kg | 15 mg/kg | 50 mg/kg | $ED_{40}$ (mg/kg/week) |
|---|---|---|---|---|---|
| | | % Inhibition hAPOL1 | | | |
| 793406 | 0 | 33 | 43 | 60 | 13.7 |
| 904763 | 19 | 29 | 52 | 62 | 9.3 |

TABLE 93-continued

Percent inhibition hAPOL1 mRNA in the transgenic mouse kidney relative to the PBS control

| Compound ID | Weekly Dose 1.5 mg/kg | 5 mg/kg | 15 mg/kg | 50 mg/kg | $ED_{40}$ (mg/kg/week) |
|---|---|---|---|---|---|
| | | % Inhibition hAPOL1 | | | |
| 905469 | 20 | 26 | 34 | 59 | 15.9 |
| 905505 | 28 | 23 | 45 | 47 | >50 |
| 905634 | 9 | 16 | 27 | 45 | >50 |
| 905665 | 12 | 30 | 45 | 56 | 13.2 |
| 972163 | 0 | 32 | 45 | 60 | 13.5 |
| 972190 | 13 | 27 | 46 | 57 | 13.1 |

TABLE 94

Percent inhibition hAPOL1 mRNA in the transgenic mouse liver relative to the PBS control

| Compound ID | Weekly Dose 1.5 mg/kg | 5 mg/kg | 15 mg/kg | 50 mg/kg | $ED_{50}$ (mg/kg/week) |
|---|---|---|---|---|---|
| | | % Inhibition hAPOL1 | | | |
| 793406 | 4 | 58 | 61 | 96 | 6.4 |
| 904763 | 17 | 42 | 72 | 93 | 5.4 |
| 905469 | 31 | 37 | 61 | 96 | 7.0 |
| 905505 | 15 | 45 | 78 | 95 | 5.7 |
| 905634 | 2 | 32 | 48 | 72 | 15.8 |
| 905665 | 3 | 43 | 79 | 91 | 5.4 |
| 972163 | 14 | 60 | 85 | 93 | 4.2 |
| 972190 | 18 | 48 | 83 | 92 | 5.1 |

Example 8: Confirmation of Dose-Dependent Antisense Inhibition of Human Lead Compounds Targeting APOL1 in A431 Cells Gapmers selected from the studies described above were tested at various doses in A431 cells.

Study 1

Cells were plated at a density of 10,000 cells per well and transfected free uptake with various concentrations of antisense oligonucleotides, as specified in the Table below. After a treatment period of approximately 16 hours, RNA was isolated from the cells and APOL1 mRNA levels were measured by quantitative real-time PCR. Human primer probe set RTS35962 was used to measure mRNA levels. APOL1 mRNA levels were adjusted according to total RNA content, as measured by RIBOGREEN®. Results are presented as percent inhibition of APOL1, relative to untreated control cells.

The half maximal inhibitory concentration ($IC_{50}$) of each oligonucleotide is also presented. APOL1 mRNA levels were significantly reduced in a dose-dependent manner in antisense oligonucleotide treated cells.

TABLE 95

Multi-dose assay with 3-10-3 cEt gapmers

| Compound Number | % inhibition | | | | | $IC_{50}$ (µM) |
|---|---|---|---|---|---|---|
| | 8 nM | 40 nM | 200 nM | 1000 nM | 5000 nM | |
| 905505 | 22 | 69 | 92 | 97 | 97 | 0.02 |
| 905373 | 13 | 55 | 92 | 98 | 98 | 0.03 |
| 905634 | 10 | 41 | 86 | 97 | 98 | 0.05 |

TABLE 95-continued

Multi-dose assay with 3-10-3 cEt gapmers

| Compound Number | % inhibition | | | | | $IC_{50}$ (µM) |
|---|---|---|---|---|---|---|
| | 8 nM | 40 nM | 200 nM | 1000 nM | 5000 nM | |
| 793406 | 6 | 15 | 53 | 84 | 93 | 0.19 |
| 905633 | 21 | 68 | 94 | 98 | 98 | 0.02 |
| 904763 | 11 | 37 | 81 | 96 | 97 | 0.06 |

Study 2

Cells were plated at a density of 10,000 cells per well and transfected free uptake with various concentrations of antisense oligonucleotides, as specified in the Table below. After a treatment period of approximately 16 hours, RNA was isolated from the cells and APOL1 mRNA levels were measured by quantitative real-time PCR. Human primer probe set RTS35962 was used to measure mRNA levels. APOL1 mRNA levels were adjusted according to total RNA content, as measured by RIBOGREEN®. Results are presented as percent inhibition of APOL1, relative to untreated control cells.

The half maximal inhibitory concentration ($IC_{50}$) of each oligonucleotide is also presented. APOL1 mRNA levels were significantly reduced in a dose-dependent manner in antisense oligonucleotide treated cells.

TABLE 96

Multi-dose assay to confirm lead compounds

| Compound Number | Chemistry | % inhibition | | | | | $IC_{50}$ (µM) |
|---|---|---|---|---|---|---|---|
| | | 8 nM | 40 nM | 200 nM | 1000 nM | 5000 nM | |
| 793406 | kkk-10-kkk | 4 | 11 | 41 | 72 | 88 | 0.34 |
| 904763 | kkk-10-kkk | 6 | 23 | 63 | 93 | 98 | 0.12 |
| 905469 | kkk-10-kkk | 9 | 15 | 48 | 81 | 94 | 0.22 |
| 905505 | kkk-10-kkk | 0 | 35 | 81 | 95 | 98 | 0.07 |
| 905634 | kkk-10-kkk | 7 | 18 | 59 | 86 | 93 | 0.15 |
| 905665 | kkk-10-kkk | 7 | 11 | 56 | 82 | 93 | 0.19 |
| 972163 | kkk-9-kkke | 2 | 36 | 85 | 95 | 95 | 0.06 |
| 972190 | kkk-9-kkke | 2 | 24 | 69 | 94 | 99 | 0.10 |

Example 9: Effect of ISIS Antisense Oligonucleotides Targeting Human APOL1 in Cynomolgus Monkeys Cynomolgus monkeys were treated with ISIS antisense oligonucleotides selected from studies described in the Examples above. Antisense oligonucleotide efficacy and tolerability, as well as their pharmacokinetic profile in the liver and kidney, were evaluated. Cynomolgus monkeys are reported to have an APOL1 pseudogene.

The human antisense oligonucleotides tested are cross-reactive with the cynomolgus genomic sequence (the complement of GENBANK Accession No. NC_022281.1 truncated from nucleotides 15021761 to 15036414, designated herein as SEQ ID NO: 1949). The greater the complementarity between the human oligonucleotide and the cynomolgus monkey sequence, the more likely the human oligonucleotide can cross-react with the cynomolgus monkey sequence. The start and stop sites of each oligonucleotide to SEQ ID NO: 1949 is presented in the Table below. "Start site" indicates the 5'-most nucleoside to which the gapmer is targeted in the cynomolgus monkey gene sequence. 'Mismatches' indicates the number of nucleobases of the human oligonucleotide that are mismatched with the cynomolgus gene sequence along its length.

TABLE 97

Antisense oligonucleotides complementary to the cynomolgus APOL1 genomic sequence (SEQ ID NO: 1949)

| Compound ID | Target Start Site | Mismatches | Chemistry | SEQ ID NO |
|---|---|---|---|---|
| 793406 | 9979 | 1 | kkk-d10-kkk | 13 |
| 904763 | 8065 | 0 | kkk-d10-kkk | 1095 |
| 905469 | 9836 | 2 | kkk-d10-kkk | 1730 |
| 905505 | 9999 | 3 | kkk-d10-kkk | 76 |
| 905634 | 10424 | 2 | kkk-d10-kkk | 1326 |
| 905665 | 10821 | 3 | kkk-d10-kkk | 81 |
| 972190 | 8066 | 0 | kkk-d9-kkke | 1164 |
| 972163 | 15761, 16086 | 2 | kkk-d9-kkke | 1925 |

Treatment

Prior to the study, the monkeys were kept in quarantine during which the animals were observed daily for general health. The monkeys were 2-4 years old and weighed 2-4 kg each. Eight groups of 4 randomly assigned male cynomolgus monkeys each were administered 30 mg/kg of modified oligonucleotide or PBS. once a week for 12 weeks. One group of monkeys received a dose of saline once a week for 12 weeks. The saline-injected group served as the control group to which oligonucleotide-treated groups were compared. Approximately 48 hours after the last dose, monkeys were sacrificed and tissues were collected for analysis.

Assessment of tolerability was based on clinical observations, body weights, food consumption, and clinical pathology. Complete necropsies were performed with a recording of any macroscopic abnormality. Terminal necropsy was performed on Day 85. Organ weights were taken. In addition, blood, CSF, and tissues (at necropsy) were collected for toxicokinetic evaluations. The protocols described in the Example were approved by the Institutional Animal Care and Use Committee (IACUC).

Target Reduction

RNA Analysis

RNA was extracted from liver for real-time PCR analysis of mRNA expression of cynoAPOL1. RTS35787 (Forward sequence: CTCCTGCTGAGTGACCATAAAG (SEQ ID NO: 1945); Reverse sequence: GGACTTCTTCGAGCCAGTTT (SEQ ID NO: 1946); Probe sequence: AGAGTGGTGGCTACTGCTGAACTG (SEQ ID NO: 1947)) was used to detect cynomolgus APOL1. Results are presented as percent change of mRNA, relative to saline control, normalized with monkey Cyclophylin A. As shown in the table below, treatment with modified oligonucleotides resulted in reduction of the cynomolgus APOL1 mRNA in comparison to the PBS control for some oligonucleotides.

TABLE 98

Inhibition of Cynomolgus APOL1 compared to the PBS control

| Compound ID | mismatch to cynomolgus sequence | % Inhibition |
|---|---|---|
| 793406 | 1 | 40 |
| 904763 | 0 | 74 |
| 905469 | 2 | 0 |
| 905505 | 3 | 0 |
| 905634 | 2 | 91 |
| 905665 | 3 | 0 |
| 972163 | 2 | 0 |
| 972190 | 0 | 93 |

Tolerability Studies

Body and Organ Weight Measurements

To evaluate the effect of ISIS oligonucleotides on the overall health of the animals, body and organ weights were measured. Body weights were measured on day 84 and are presented in the Table below. Organ weights were measured after euthanasia and the data is also presented in the Table below. The results indicate that effect of treatment with antisense oligonucleotides on body and organ weights was within the expected range for antisense oligonucleotides. Specifically, treatment with ISIS 972190 was well tolerated in terms of the body and organ weights of the monkeys.

TABLE 99

Body and organ weights in Cynomolgus Monkeys after 12 weeks of treatment with modified oligonucleotide

| | Body Weight (g) | Heart (g) | Kidney (g) | Spleen (g) | Thymus (g) | Liver with gall bladder (g) |
|---|---|---|---|---|---|---|
| PBS | 2473 | 9.7 | 12.6 | 2.3 | 3.5 | 50 |
| 793406 | 2419 | 9.1 | 11.9 | 3.5 | 3.0 | 53 |
| 904763 | 2511 | 9.5 | 14.3 | 2.9 | 4.0 | 56 |
| 905469 | 2395 | 9.3 | 16.0 | 3.5 | 2.5 | 59 |
| 905505 | 2550 | 9.4 | 12.9 | 4.7 | 4.5 | 65 |
| 905634 | 2488 | 9.8 | 14.7 | 3.6 | 3.2 | 61 |
| 905665 | 2462 | 9.8 | 14.2 | 3.9 | 4.1 | 56 |
| 972163 | 2606 | 10.8 | 14.8 | 3.3 | 4.2 | 68 |
| 972190 | 2666 | 11.0 | 14.6 | 3.0 | 3.6 | 64 |

Liver Function

To evaluate the effect of ISIS oligonucleotides on hepatic function, blood samples were collected from all the study groups. The blood samples were collected via femoral venipuncture, 48 hrs post-dosing. The monkeys were fasted overnight prior to blood collection. Blood was collected in tubes containing K2-EDTA anticoagulant, which were centrifuged to obtain plasma. Levels of various liver function markers were measured using a Toshiba 200FR NEO chemistry analyzer (Toshiba Co., Japan). Plasma levels of ALT and AST were measured and the results are presented in the Table below, expressed in IU/L. Bilirubin, a liver function marker, was similarly measured and is presented in the Table below, expressed in mg/dL. The results indicate that antisense oligonucleotides had no effect on liver function outside the expected range for antisense oligonucleotides. Specifically, treatment with ISIS 972190 was well tolerated in terms of the liver function in monkeys.

TABLE 100

Liver function markers in cynomolgus monkey plasma

|  | ALT (IU/L) | AST (IU/L) | Bilirubin (mg/dL) | Albumin (g/dL) |
|---|---|---|---|---|
| PBS | 37 | 57 | 0.3 | 4.3 |
| 793406 | 59 | 55 | 0.3 | 4.3 |
| 904763 | 50 | 48 | 0.3 | 4.4 |
| 905469 | 54 | 68 | 0.2 | 3.9 |
| 905505 | 46 | 54 | 0.2 | 4.1 |
| 905634 | 566 | 417 | 0.5 | 4.1 |
| 905665 | 57 | 80 | 0.3 | 4.3 |
| 972163 | 58 | 81 | 0.2 | 4.1 |
| 972190 | 47 | 46 | 0.2 | 4.2 |

Kidney Function

To evaluate the effect of ISIS oligonucleotides on kidney function, blood samples were collected from all the study groups. The blood samples were collected via femoral venipuncture, 48 hrs post-dosing. The monkeys were fasted overnight prior to blood collection. Blood was collected in tubes containing K2-EDTA anticoagulant, which were centrifuged to obtain plasma. Levels of BUN and creatinine were measured using a Toshiba 200FR NEO chemistry analyzer (Toshiba Co., Japan). Results are presented in the Table below, expressed in mg/dL.

A urinalysis was also conducted prior to sacrifice using a COBAS U 411 analyzer, Combur 10 Test M urine sticks (Roche, Germany), and a Toshiba 120 FR automated chemistry analyzer (Toshiba Co., Japan). Urine was tested for potassium (U-K), microprotein (UTP), creatinine (UCRE), albumin (UALB), chlorine (Ca), sodium (Na), and the protein/creatinine ratio was calculated (P/C). The results are presented in the tables below.

The plasma and urine chemistry data indicate that most of the ISIS oligonucleotides did not have any effect on the kidney function outside the expected range for antisense oligonucleotides. Specifically, treatment with ISIS 972190 was well tolerated in terms of the kidney function of the monkeys.

TABLE 101

Plasma BUN and creatinine levels (mg/dL) in cynomolgus monkeys

|  | BUN | Creatinine |
|---|---|---|
| Saline | 25 | 0.7 |
| 793406 | 24 | 1.0 |
| 904763 | 25 | 0.7 |
| 905469 | 28 | 0.8 |
| 905505 | 27 | 0.9 |
| 905634 | 27 | 1.0 |
| 905665 | 24 | 0.8 |
| 972163 | 30 | 0.8 |
| 972190 | 20 | 0.8 |

TABLE 102

Urine levels in cynomolgus monkeys

|  | P/C (ratio) | Creatinine (mg/dL) | Albumin (mg/dL) |
|---|---|---|---|
| Saline | 0.08 | 84 | 0.3 |
| 793406 | 0.14 | 71 | 1.7 |
| 904763 | 0.04 | 44 | 0.03 |
| 905469 | 0.10 | 52 | 0.2 |
| 905505 | 0.02 | 77 | 0.1 |
| 905634 | 0.06 | 106 | 0.5 |
| 905665 | 0.04 | 124 | 0.4 |
| 972163 | 0.01 | 69 | 0.2 |
| 972190 | 0.03 | 34 | 0.01 |

Hematology

To evaluate any effect of ISIS oligonucleotides in cynomolgus monkeys on hematologic parameters, blood samples of approximately 1.3 mL of blood was collected from each of the available study animals in tubes containing K2-EDTA. Samples were analyzed for red blood cell (RBC) count, white blood cells (WBC) count, individual white blood cell counts, such as that of monocytes, neutrophils, lymphocytes, as well as for platelet count, hemoglobin content and hematocrit, using an ADVIA120 hematology analyzer (Bayer, USA). The data is presented in the Tables below.

The data indicate the oligonucleotides did not cause any changes in hematologic parameters outside the expected range for antisense oligonucleotides at this dose. Specifically, treatment with ISIS 972190 was well tolerated in terms of the hematologic parameters of the monkeys.

TABLE 103

Blood cell counts in cynomolgus monkeys

|  | RBC ($\times 10^6$/µL) | Platelets ($\times 10^3$/µL) | WBC ($\times 10^3$/µL) | Neutrophils ($\times 10^3$/µL) | Lymphocytes ($\times 10^3$/µL) | Monocytes ($\times 10^3$/µL) |
|---|---|---|---|---|---|---|
| Saline | 5.9 | 380 | 8.7 | 2.5 | 5.8 | 0.2 |
| 793406 | 6.8 | 437 | 11.1 | 4.4 | 6.2 | 0.3 |
| 904763 | 6.1 | 412 | 10.6 | 5.2 | 5.0 | 0.2 |
| 905469 | 5.6 | 483 | 9.8 | 6.1 | 3.4 | 0.2 |
| 905505 | 5.8 | 400 | 13.2 | 5.5 | 7.0 | 0.4 |
| 905634 | 6.3 | 340 | 9.9 | 4.0 | 5.2 | 0.3 |
| 905665 | 6.0 | 440 | 8.3 | 2.8 | 5.0 | 0.2 |
| 972163 | 5.9 | 377 | 11.5 | 5.4 | 5.5 | 0.3 |
| 972190 | 6.0 | 392 | 10.5 | 4.5 | 5.6 | 0.3 |

TABLE 104

Hematologic parameters in cynomolgus monkeys

| | Hemoglobin (g/dL) | HCT (%) |
|---|---|---|
| Saline | 14 | 44 |
| 793406 | 15 | 47 |
| 904763 | 14 | 45 |
| 905469 | 12 | 41 |
| 905505 | 13 | 42 |
| 905634 | 14 | 46 |
| 905665 | 13 | 43 |
| 972163 | 13 | 44 |
| 972190 | 13 | 43 |

C-Reactive Protein and C3 Activation

To evaluate any inflammatory effect of ISIS oligonucleotides in cynomolgus monkeys, blood samples were taken for analysis. The monkeys were fasted overnight prior to blood collection. Approximately 1.5 mL of blood was collected from each animal and put into tubes without anticoagulant for serum separation. The tubes were kept at room temperature for a minimum of 90 min and then centrifuged at 3,000 rpm for 10 min at room temperature to obtain serum. C3 levels were measured to evaluate any complement activation due to oligonucleotide treatment. C-reactive protein (CRP), which is synthesized in the liver and which serves as a marker of inflammation, was measured using a Toshiba 200FR NEO chemistry analyzer (Toshiba Co., Japan). The results indicate that treatment with ISIS 972190 did not cause any inflammation in monkeys.

TABLE 105

C-reactive protein levels (mg/L) in cynomolgus monkey plasma

| | CRP |
|---|---|
| Saline | 1.7 |
| 793406 | 1.4 |
| 904763 | 2.4 |
| 905469 | 8.4 |
| 905505 | 4.1 |
| 905634 | 6.7 |
| 905665 | 10.7 |
| 972163 | 4.7 |
| 972190 | 9.5 |

Oligonucleotide Concentration Analysis

Quantification analysis of the concentration of each antisense oligonucleotide in different organs was performed. Most of the oligonucleotides had an acceptable pharmacokinetic profile in the liver and kidney.

TABLE 106

Antisense oligonucleotide concentration (µg/g tissue)

| ISIS No | Liver | Kidney |
|---|---|---|
| 793406 | 349 | 1253 |
| 904763 | 296 | 982 |
| 905469 | 288 | 2636 |
| 905505 | 547 | 1712 |
| 905634 | 516 | 2307 |
| 905665 | 392 | 942 |
| 972163 | 553 | 2054 |
| 972190 | 978 | 2654 |

Overall, the results of the study indicate that ISIS 972190 is the most potent and well tolerated compound of those tested for inhibiting APOL1 and is an important candidate for the treatment of APOL1-associated diseases.

SEQUENCE LISTING (1950 sequences)

SEQ ID NO: 1 - DNA, 2885 bp, Homo sapiens
  source 1..2885: mol_type = other DNA
gactttcactttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggaaaaaaaaaaaaaaaaaaaaaaa

SEQ ID NO: 2 - DNA, 15454 bp, Homo sapiens
  source 1..15454: mol_type = other DNA
agaaccagctactcaggaggctgaggtggggggatggcttaagcccaggggtttgaagctgctgtgcgcgatgactgtggcactgcaattcagtcttggtgacagactgagaccctgtctcaaaaacataaccaaaataaccccaacggcattacaataaatatacaataagcatccacaaggcatgtgtgggagactgtgcttatgccgatggcacgggcaggagtaaggcaggcatcaggggaatgtggatgcacgggaggatggggagtaatctgcagggtcccatagtatgtcagtggcaggtctttctccttgagaccacagcagacccccagccctgaggatgcgaggcaggtgggttggatgagagggatctggatgtctggtctcaggctgctcctctaagggcagcagcaaggagggtggggctggactgaaggtggaggggagcgtgtttgctgtgcttggtcatgagctgctgggaagttgtgactttcactttccctttcgaattcctcggtatatcttggggactggaggacctgtctggttattatacagacgcataactggaggtgggatccacacagctcagaacagctggatcttgctcagtctctgccaggggaagattccttggtaagttggggacagttgacctgcctccatcttattctcacagcttttgtagataagctgggagaggttaggtgactggttcagatagacaggaaagtagcggcaaagcctggatttgcacccaggcttgagtctgattgcttcccctctcctgctgggctcttaaactatagagggttggggaaacagctcagatgggttcacaaagctccctgggctcagccctggttttgactgctgagacacgactgagtgaacccagaaggaaggtttgtgttgggggtgcccatctctttgggaaatttgaaggaaccaaagaaggtggaggagaggaggtgacccagatcccagcctgttcttatggccaggccacaccaaggctggccccagggtgctgctgctgaggcccaatgggggcaacagaattttttttcaggtacaaggagttcagaggtcatctcacccaccctgagtctgagcaccaacttgtgccaggccctgtggggaaactgaggccctgggagcggaatgacttgcccagggtcccgtgtcaggaggctgagcaggtagatcataggactccacgtctctggccctcacctctgtccctctgttcagacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgtgagtataactacaggagtgagagcttagatctctgtgttcatagaaggagaatcaaacctggaaacttttggattattaaaatcaaacatttttgcttcaatattagagtcacaagggcagatgttggcctcccctctgccctccaagagctgtgtgactctgggaaattcacctcccctcccagcctgagtattttcccctgtaaaaaacctgatagagctgccaaaagtccatgaaatcaggggggtaatttctgtgaaatctgagtcatggtcttatttgttcttcaccaaaaagagatgatgaagcctgtaaccccagtgctgtgggaggcagaggcgggaggatgacttgaggccaggagttcaagacagcctgggaaacacaggagatgctgtctctatgaaatcaaaaattaacaaattagcccagcatggtagtgtgtacctgtagtcccagctactcagaaggttgaaggaggcggatcacttgagcccaacagatctaggctgcaatgagctaggatggtgtcaaagccctgcagcctgggtgacagagcaaaactgtttattaaaaactaaacgaaaggccgggcgcggtggctcacgcctgtaatcccagcactttgggaggccaagacaggtggtcacgaggtcaggatatcgagaccatcctggctaacatggtgaaaccctgtctctactaaaaatacaaaaaaattagccgggtgtcgtggcgggcacctgtagtcccagctactcgggaggctgaggcaggagaatggcgtgaacccgggaggcagagcttgtagcgagcctagatcgccccactgcactccagcctgggtgatagagcgagactccatttcaaaaaaaaaatgaaatgaaaatggtgatttctcaggaggagcacactgtctcaacccctcttttcctgctcaaggaggaggccctgcagcgacatggagggagctgctttgctgagagtctctgtcctctgcatctggtgagcttggctcagagccctgaggcgggagggagggctccctgtctgggctgcacaattggactgggcttgggctgggccagggccatctgggcttcttctaggaaccaaagtcacttcccggaattgaccaaccggcagactcgcccagggaggacccgctgtatcctagttgaggctaacggtcaatatccggcctcaatattcagcagaggctccaggtcagggtctgagccaggccaacaatgaccaaggaggatgggatccagggtgcagctcctcacaagtgtcgggggaatccgaggcaccagctctctctaccctcctgctcctctgctctctcctggtcctcctgtgtcctcatggctcatgagatggtgttgagatggctcccctggcctaggggatcacacagtgaacaaagcaggaagaaggcgaagggatgcccctctcctgtcacccttgtcccttacagcaagaagggcccagacgcccctctgcatactcccctggtgaactgctgcccaggactgggtcccccttttacccttgctgcatggagtccccagaagacaaacatctgtgtgtctgaaccctgagacaaaggcaggaaagggaaagagggaggcgagtggcttttgaggagggggctttagtatgagagctggaggatggaaccccatcagggggcccgggaaccactgagctgttaaaataaagtctgcaaacaaagaccagctgctggaagtgggtgtgccagggagtgcgcagagacacacggtgagaaaagaacaatggtaatgcttggagccgcccctaactgggatgggcctgaaatggtattgttattatttatagtatcattattagtcattttcatcttatttgtaccctccctctatctctcctctccaccttttcctaacattctatcaccagttttatgtcttccattagcaactttgtagctgtaaataatttacttacaactttcatataccctcagttgtacccagtatttcttaacttccctctttaaaaaaatgataatattaatcctccttctccttcgttcagtgcttcacatcccaactgctacctttgtgctttaaattttgtactaattggtgttgataacaagtatatttagttctcatatttatatgttgtgtatatgttttggtttttttttgtcttaaacaagagactactgagagccagtaagactgaaagaaagggcatcttcatatactgctagtttgagtgtgaattggtacaatttgcctgcagtgtggctctaggtataaagccttttgagttgttgatagcctctgacctgctcattctactcctacaaatatcttaaggaaataatctcaaatgtgggcaaagttttatgcgaagaaggatgttctttgtagcataatttatatgaggaattagaaacaccctgaggtccatcagctagggaaagacagcagaggggacagggcagcaccaggagggcttggcagccacagcaggggctgggctggcatctggcaagatccaggtctttgtgggacaaagaatcttagagaagcaacggggacacaggctgtccagtgcagcaccagtgaattcaccaagatgaagagttgagcacagagtgtgagacaaggatttgcaatgaggagtcatttaccatgagcgtgtatacatgactcaatattgtatatttaagggagtagagcacagtcattgaaaacatggggttgaagcagaagtcctggctctagcactattgtaaaaacactggcaagttccctaacttttgtggattcctctgtgtttgaatgggaaagtggtacccatctcctggcctgtgtgtgatcatcgaatgagacacatgtaagaggctctgcacatcgcagacatgcaatacacactggctatcaccagctagttatcacacatgctcccaggccctggtcattgtcagaaccttcctccccatctctatttctgtgtatagactctgtagtttctgtaatgatcagatggctgcccgtcctctgattatcttctcctcataccccaacaggatgagtgcacttttccttggtgtgggagtgagggcagaggaagctggagcgaggtgagtgtctgcaaatagcagatgatgggggctcagtgatagacaaacaatctggtttaggttggtcttggtgtttgcttccaccccagagagatttgcagagccccggctgctcaagcaagcctccctctgtccactggtggctcacatttgatcccacaatttgttttctcctcctcaagggtgcaacaaaacgttccaagtgggacagatactggagatcctcaaagtaagcccctcggtgactgggctgctggcaccatggacccaggtaggctcacctcctcttccctgctggttcctactcgcacttagaatggagggtggcacctccacagctgagtgagccccagaagaacccggatggactaggaggccaatgagtctgcccaaagcagcagaagaggtcacgtggagtcccccgacccaggggtctgggggtcatctgcatcctgacctctccttagggtgacacggcccaggtgcccacttcctccctaccctggcacctagcaaatgactcaagtggggcaggacatccttggggaagtggaatcagcgggggggggggggagtgtggggagagcagggtccaggaggagaggagggctgggagaggaggttgaccagcagccccgacctgtcacctcccgctctgctccaagctgaccctggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtaccatgagaataatatttccccatgttgtcttgaggatcaaatataacacggctacctggcctggccagtgcctgccacacaatagggcctccctaagggctggttcccatcccctctactggtcccctgttgattccaggtggaagccaccccgtccccccccagctgtgttagggcacccgccctgccctgcccatcacaagcacctgcttaccagggatgactgcctcaggcaggggctgagttcagtcatctaaaatacccccggtcaaagaaaaatctgaggcccaatagaattttaaagagttaattgagtaagaaaggattgctgaattgggaaacagcaaactggaggaggcttcgtgctatggtgaaaaagtgtcggagacaaggtttatcgggtgaatatgaaactgcagtaaggacattatttgattggttgcacttacaaaactgcctgtttgggtttaccttgttggaaaatccctggtcacgttggtgccagtgtgagtttagggaggtctccgaatacaggtgagaccggaacttagccttgcccaggtttttgatgctgaagagagaaaaaagtcaaagcaaaagcaaatcagcttttagtgcaaaacagaagtgcaggctcaggggtgggagtgcaggcggactcagaagagccagtcgggcccagtggagtttggggttcttgtctttgctggtttattaaattaaggtgtggagtaagcataaggatttctgggaagaggtggggatttcttggaattgggagggcaatgcagttttgtaccaaacatgggcatacatggaacggctgtggtgcgggtgggtgtggggtttagtgagacaaggagggtatgattgagtgtgaggcaaaacgtgggtcagacccagcgccgagttggatctcactggtcttagctgaattggccacttcctgtttgtcaggatcctgtgggcccatcccctccccctgtccctacaggtggtttcagcaactccttctgtgtctgtcatgtgaacctgctgcctggagttcttgtttcttctgtgacctcccagtatccacatctcagcatggccctctgtcagctggctttaagttttgtttgtatctaacagaagtacccatctgatatgaccccagttgagtttcccatagcttgcagtttcagggggttacagctgttctaaaggcctcgtaggtattgcctgtccaggaatgtttcagggctggtttttgttttaattttgcttttatatccaccagccccaccacatcaagaaatacacagatttagtgccagaggttccttccatccaaacctgggtttccttcctccttttggtgaagaaggaaaaagaaaaaacaagacaatcgctcgcccagccaagtcagcattgcgttcatttccctaagccccatttcctcaggagggcttcctccccttacagagttgccacggcaaccaagtcagctctgctcaggagccgccctggacagcaaactgggctgtgctgagtcctgtccaagacgaggggagggcagggaagattagaagccgagagcactcagccgaccccggaatccttacgaagggctgggctgggggactgaggaaaaactctccccccaaaacaagatgatctgtggtttaataacaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatagccccacaggtaagctataagggagaatgcagagaccacaggcattttcaaaacataaggagttttaatgttaaggagtttaaggagaatgtcaaagaaacattggccttggagtcaaatcctgagcttcctgcttgatggttttgggcggtgactctcgctgtctggattttactttcttcatctgtgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatccccccaaaaaaaagaatgaggtctcttgtgtgtgcacggcaagaaacaattttacatcatgcctcagtgcacacacaaatacatactggtccccagttccttatctgcaattccataattcccagatccctgcaaaccacacgttttggtggcagctgacttcaggagtaatcctgctctgtactgacttgagttctttgtagacctaccattattttttacatttaatgtgaatatttgcttgtttcactgttgaaacatgtgtgggtgtgattacagggagcagtccagcctctgctgggaatggtcaggaatataccatatgcaccccgtgtcctttctaaaatagtggaaattctgaatgcctaaacacatctggattccaggaatttacattaagggatatatatttgaaataacccacaaaaacaatactcacccctgctacgcttggtacactctgatattttcaaattgattttctttttaaaatgctgcttttgaaccaataatttcataacccaatgatgtgttgatattcacattttgaagacactggtataaagtgtttgacccaacaggcatgtggcagatggaagtgatcactgggatgtttccacttccttggcctggaaggctcacttcatgttggtgctgagctgaaaaggattcattcctctccaaagcaccatggcactcccctggtgtttcaatgttctcaggctgccatagtaaaatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctcacacagtcttcttgtgtccctttctgttcttacaataggacactagccctctaatagaattagagccctacccttgtgatctcattcagtcttaattgcttccttaaaggccagatctccaaatgtagtcacctgagtttaaagcttcagcatatgaattttgggggcacacaattccctctatagcactaatgactccataaaacaagtcccacatcacagctgtccaggaaaattaacatgtagtcatctcttatgcaatggctgttatgcactcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggtaagctccatggggttacctccattgggcactccggcgatgccacccagctctcccctgggctagttttccctgacaggcacacctcctccaggcagccccctctgctgggcttgaggatgaccttcttggcactccaggaagaatatttcctccatgtccttcgctggcagtgagtagcctcaggctgaggggataggaagcccacaggaacagggtcatttctgccatctgctggtgatgggaactttgccagttactttctcactttcagcctttcttcatcaatggagttttattgtgagaaaaatgagatcgtgcatgtaaagtgcttagcataatgactgacacacagtaggtgcacagttaacgttaacatcttacaagcttggtggaaacagaaccagggttaaggatcttcttcttgaagatgggagcccagcaggacttgacctttgggacaagtcagaaaaatcctgacctaaccaatgtgtgttcctggggatgctggctggagccctttttctcatctgaggaattccataaacacggcaggacccttctgctggtccaggatgccgagaggctggagtggagttgcacagcgctgggtctctttccagctctgtctgtgtccagtccctgggctctgggcttatgtcagagactggaaactgtcatcagtctaataggaatagcaactcaatgtgataggagtgtggtgaaggccttagaggcaactccaggtcaaaggtggggaaccaacaccaagatcctgcccaaaggcccagagagaccgggatcagcgtcagagcctggagtcaggatggagcaagagtcagccttggttgtaggacaagcaggaaggctggggcaccagggctgggactagggtgtggaaagagaggcaccaagggcttgaaacttaaggaggtcatgaacttgcagaggacatgtgagtgggagagggatatttcttccctgtctggatgatcccaacactcatgggcatatagggtcatggttgcctgtgtctctcacaccacgccttggaactggcaagttctgggctaccctttgagaccttcttctcttctacacagagaaacccctgacattgacaagcagtatgtcttagtgaccattttcatagtagaattagttgctgccaatttgtgtaatttcagggatactgagcagactcacaacttcccaaccaaggaggaaaacacttcctctaccatcttgtccaaattcaggtcttttcagcattagcaatttatataggtggttctgaaagtgttttgaatcttctagaggttccataaaattgcaaatggccttggtgtgcacacaggtgaagctgtcactactaaggcatcagttaggctggtgacacctgcgagtgagacctggaaggttgggggtgcaggtggtaggtcaggaggcagtaaggtggctggagcgtccatgtggagccagaatgaatagccagatctcccactccagtcagctggggcagtggccagaaccagtagccttcagccaggtgaaagggcatgaggcattggaagggagcagatgccaggcaaagtgaactcctgtctctccggggttttgtttttgtttgaattcaaagtactcagagatagccagactgcaatgtctgagggcacccttacctttgacaccacctgcaaatttaaggggatttctaaatccatcctttgattttgtaattcactggaaggactcacataactcactgaaaactgctatttcacaattgtggttgatcacacggaaagaacacagattaaaatcagcctaagaaagagacacacggggcagagtttgggagggttttaagtgtgaagcttcattgtcctcaggacgctgtgttctcctgtgtgaatgtgggacaaaacacatgcggtgttgccaaccagggaagctcacccagttaaggaaaaattcctgtgaatcacattaaaccagaaatgaagccttttttcaggattgttgttacaggggagggagactgagcccagctccaaatatagtaaagacagagggggagtcacagccaacaccagggtgggggcgggagatggaacaggactgataggagacaccagagtggggggttcctgctaaattggcctaacaggattctcactaaaggcaggtcagacactcacccatcaatggtgggggtgaagagcataatcagatagcaaagcgtaatcagacagcaaggggggaagaccctccctaaactgacttggggagattcttgctgagctgggtggtgcaggtccagcaagcagtgggtggctgtggaaggccaaggtcggcgcctagtggagaagaggctcagaagagcccagctggagttggtcaaggagaaagtccttctttctcaacccatgccttagtgtccagagtatctgctggggctggatcacaagctgccctcatggctgacctggagtctccagcccctccctgaggtctaacccctttagtccccgggtcctctgggatcaggaaagacaccaaatagccccaaaccccatcatccatcagattcctatacggtcccgtggccaaatcaccaggcaaagacagatgttcctaccaggcaggacattccaggggcctggagatcacttcccaggagctgaggacaaagggaaggcctctctttgggtaaagttcatgcttcactttcctgccatcctgggaataaggtctctttgtctcactctcactgctctttgttcatctgcagagttttccctctccaaacactttggcagtcacggtgttgacctgcccttgaatgaggaggcatctttatcaaacacctaccatgaaagagcatctgagatgcctttaagatatttatttccatatggaataaatattgaggagtatctatgatgaacaaaatgtgtttgagtttgaaagataattaattccatttgtaaaatttgtttctatttgatcgatagtgaaagctctgcaatttacacaggatagagatcacatggagctcatttcacagacagggaaactgcatttcttttttttttttttttttttgagttggagtcttgctctgtcgcccaagctggagtgcagtggcgcgatctcggctcactgcaagctctgcctcccggttcaagcaattctcctgcctcagcctcctgagtagctgggactacaggcgcccaccaccacgcccggctaattttttgaatttttggtagagacagggtttcaccgtattagtcaggatggtctcaatctcctgaccttgtgatccacccgccttggcctcccaaagtgctgggattacaggtgtgagccaccacaccgagccaaaactgcatttcttaatcctttaacctttccttgtgcaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaatggtggtgatggtggttgtgatggcagcagagtggtgggggccttggcaagtggtcggtgctcttccagaccaggggacaccgatggaccgatgaagttccaggggaacttgaagtgctgtgttggaaagaggttaatttgggaagaaaggaaaaatgaaaggagatgccaggaacaggtcaaggaaccttgaggtgtgtccaggagttcaaccccgcttgtggtcacgagacctcgcctctctgagcctcagtttcctcatcagctgtagaagggtacctggacaaggtgatgtctcaggtccacccagctctccccatcttgtgtcctggagacttgggtccaatcagcactgactgatggctgtgcctttgtggtgccgatggaggctcccctgggctctgggtgcctgacttcccttcctc

SEQ ID NO: 3 - DNA, 2831 bp, Homo sapiens
  source 1..2831: mol_type = other DNA
gactttcactttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctgggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggaaaaaaaaaaaaaaaaaaaaaaa

SEQ ID NO: 4 - DNA, 2924 bp, Homo sapiens
  source 1..2924: mol_type = other DNA
gactttcactttccctttcgaattcctcggtatatcttggggactggaggacctgtctggttattatacagacgcataactggaggtgggatccacacagctcagaacagctggatcttgctcagtctctgccaggggaagattccttggaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggaaaaaaaaaaaaaaaaaaaaaaa

SEQ ID NO: 5 - DNA, 3039 bp, Homo sapiens
  source 1..3039: mol_type = other DNA
gactttcactttccctttcgaattcctcggtatatcttggggactggaggacctgtctggttattatacagacgcataactggaggtgggatccacacagctcagaacagctggatcttgctcagtctctgccaggggaagattccttgacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggaaaaaaaaaaaaaaaaaaaaaaa

SEQ ID NO: 6 - DNA, 541 bp, Homo sapiens
  source 1..541: mol_type = other DNA
tggactgaaggtggaggggagcgtgtttgctgtgcttggtcatgagctgctgggaagttgtactttcactttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgccca

SEQ ID NO: 7 - DNA, 1784 bp, Homo sapiens
  source 1..1784: mol_type = other DNA
aaaaattttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagagttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcggctcactgcaagctctgcctcccgtgttcaagcgattctcctgccttggcctcccaagtagctgggactacaggcgcctaccaccatgcccagctaatttttgtatttt

SEQ ID NO: 8 - DNA, 210 bp, Homo sapiens
  source 1..210: mol_type = other DNA
tggactgaaggtggaggggagcgtgtttgctgtgcttggtcatgagctgctgggaagttgtgactttcactttccctttcgaattcctcggtatatcttggggactggaggacctgtctggttattatacagacgcataactggaggtgggatccacacagctcagaacagctggatcttgctcagtctctgccaggggaagattccttg

SEQ ID NO: 9 - DNA, 21000 bp, Homo sapiens
  source 1..21000: mol_type = other DNA
caaaagaaactagagaatgcctgttattggattctagctttctccattgttttctagccgtattgtttgtccacagtttatctggactacatactgaattctttcctggccacaagtctccaaactaatattttgcttttctttttctctcatttttctgacttggaatcaccagaaatccaaactgtgcttttcttaaagtcctgcaaactgaagcttgaaaactgtgttatagtgaaggaagagaaagaccctctcatattatttttatattgttttgtactcagtacctgttttaagaaaaaacaacaaggaagtaaaaccaaagacaggcagcccggcgccaggcccgaaaccaggcctgggcccgcctggcctaaacccattagttaaaaatcaacttatgattcagaagccgatgttattcatagattccttacattatgtagaagaacattgtgaaactccctgccctgttctgttcccccctgacgacctgtgtatgcagcccctgtcacgtaccgcctgcttgctcaaatcaatcatgaccctttcgtgtgaaatctttagtgttgtgagcccttaaaagggacagaaattgtgcactcagggagctcggattttaaggcagtagcttgccgatgctcccagctgaataaagcccttccttctactactcggtgtctgagaggttttgtctgcagctcgtcctgctacaatagaattcagaccaaactcgtgaccagagactcatttgcttctacagtgttttgtccaaaagatgttgaagaacggccaggcgcagtggctcacgcctgtaatcccagcgctttcggaggccgaggcaggcagatcacaacgccaagagatcgagaccatgctggccaagatggtgaaacgctgtctgtactaaaaatacaaaaattagctgggcttggtggtgcgtgcctgtagtcccagctacttgggaggctgaggcaggagaatcacttgaacccgggaggtggaggttgcagtgagccgagatcacaacactgcactccagcctggcaacagagcaagaatctgtcaaaaaaaaaaaaaaaaaaaaagttgttgaagaacaaggagaaaacgtgaaaggaaaatcaaatcttgggaccccaaaactcactggaaacagttaagcttagaaacggagtcactccaaaacctgcctttgtttttgcttctaagcagatatttgcgaagacaaaaggcaacatgttccccaggtagcctccttcacaaattgctcacaaggaaactccttgtgggtcccagcagtttttaccctgaggcagactttgtgtaatttcattgtgacaatgcaaattagcaacttatctttactggtacatgataaataacaagacttctgcccaccctcagaaaaatgcacatatgcctgcttcctctactctatgttcatttttatcttatataaaatgtagacgaactgtgcatgagacgaatgaataattgactgttcctctaccccctcctttcatagacaacctgtggattcaaggagggctaatcaaagcttcacaagaatgtgaccactcacctcattacctatcctgtcttttttcctttcctccttccactcctgcctgattttacacatttaaatactggaggcctcaaaaccctctgtgaaaaacgagtggaccccagaacctcctgtgacttgtgtgactttttcctgggtgcatcctcaaccttggcagagtaaacatctaaactgactgagacgtgtcccagaccctctttggtttacaagtcttgcctcctccctgagttgctggatgaaagcaacgtcctctcttcttgcctcagtttcctcatctgcaaaatcagatcataatcctggcccattgaggggatgattataaaactcaatcaaatggagaagcatttgcaaatggaatgtattgcaaagtgtattgtgcagtccctgtgtaatcaccattctcttcctgcctcataagctggtgtgtgtgtgtgtatgggtggggtgaggtggacacgatgcccccagagatgtttgctcaggatgaaataggcccccatggaagggtcaggttggcttctgtggtttagctgcctttgaggcccttctgcctggggcaaagcacaaaagtccaatagcaatctggttgcatgacttcctagtcatggaagtgtggctgagcagtggtctctagtccctccaccctgtgtgcctcgggagtggaacacggggcagtggcctctgctggggaggatgctgggggatctctgaaaggaggcaatgcctgattttgtcactgaacgatgagcatgatttttccaggcggtggaagcaggtgctcccggcagaagaccccatataagcaaatatctagaagccacaaggcatggccttcaacaagagcaggcctggtgcggtggctcatgccaaggtgggaggatcacttgaggcctggagttcaagagtagcccagtcaatatagtgaggcaccatctctaatataatttttttaaaaattagctgggtggttggctgatacctgtagaaccagctactcaggaggctgaggtggggggatggcttaagcccaggggtttgaagctgctgtgcgcgatgactgtggcactgcaattcagtcttggtgacagactgagaccctgtctcaaaaacataaccaaaataaccccaacggcattacaataaatatacaataagcatccacaaggcatgtgtgggagactgtgcttatgccgatggcacgggcaggagtaaggcaggcatcaggggaatgtggatgcacgggaggatggggagtaatctgcagggtcccatagtatgtcagtggcaggtctttctccttgagaccacagcagacccccagccctgaggatgcgaggcaggtgggttggatgagagggatctggatgtctggtctcaggctgctcctctaagggcagcagcaaggagggtggggctggactgaaggtggaggggagcgtgtttgctgtgcttggtcatgagctgctgggaagttgtgactttcactttccctttcgaattcctcggtatatcttggggactggaggacctgtctggttattatacagacgcataactggaggtgggatccacacagctcagaacagctggatcttgctcagtctctgccaggggaagattccttggtaagttggggacagttgacctgcctccatcttattctcacagcttttgtagataagctgggagaggttaggtgactggttcagatagacaggaaagtagcggcaaagcctggatttgcacccaggcttgagtctgattgcttcccctctcctgctgggctcttaaactatagagggttggggaaacagctcagatgggttcacaaagctccctgggctcagccctggttttgactgctgagacacgactgagtgaacccagaaggaaggtttgtgttgggggtgcccatctctttgggaaatttgaaggaaccaaagaaggtggaggagaggaggtgacccagatcccagcctgttcttatggccaggccacaccaaggctggccccagggtgctgctgctgaggcccaatgggggcaacagaattttttttcaggtacaaggagttcagaggtcatctcacccaccctgagtctgagcaccaacttgtgccaggccctgtggggaaactgaggccctgggagcggaatgacttgcccagggtcccgtgtcaggaggctgagcaggtagatcataggactccacgtctctggccctcacctctgtccctctgttcagacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgtgagtataactacaggagtgagagcttagatctctgtgttcatagaaggagaatcaaacctggaaacttttggattattaaaatcaaacatttttgcttcaatattagagtcacaagggcagatgttggcctcccctctgccctccaagagctgtgtgactctgggaaattcacctcccctcccagcctgagtattttcccctgtaaaaaacctgatagagctgccaaaagtccatgaaatcaggggggtaatttctgtgaaatctgagtcatggtcttatttgttcttcaccaaaaagagatgatgaagcctgtaaccccagtgctgtgggaggcagaggcgggaggatgacttgaggccaggagttcaagacagcctgggaaacacaggagatgctgtctctatgaaatcaaaaattaacaaattagcccagcatggtagtgtgtacctgtagtcccagctactcagaaggttgaaggaggcggatcacttgagcccaacagatctaggctgcaatgagctaggatggtgtcaaagccctgcagcctgggtgacagagcaaaactgtttattaaaaactaaacgaaaggccgggcgcggtggctcacgcctgtaatcccagcactttgggaggccaagacaggtggtcacgaggtcaggatatcgagaccatcctggctaacatggtgaaaccctgtctctactaaaaatacaaaaaaattagccgggtgtcgtggcgggcacctgtagtcccagctactcgggaggctgaggcaggagaatggcgtgaacccgggaggcagagcttgtagcgagcctagatcgccccactgcactccagcctgggtgatagagcgagactccatttcaaaaaaaaaatgaaatgaaaatggtgatttctcaggaggagcacactgtctcaacccctcttttcctgctcaaggaggaggccctgcagcgacatggagggagctgctttgctgagagtctctgtcctctgcatctggtgagcttggctcagagccctgaggcgggagggagggctccctgtctgggctgcacaattggactgggcttgggctgggccagggccatctgggcttcttctaggaaccaaagtcacttcccggaattgaccaaccggcagactcgcccagggaggacccgctgtatcctagttgaggctaacggtcaatatccggcctcaatattcagcagaggctccaggtcagggtctgagccaggccaacaatgaccaaggaggatgggatccagggtgcagctcctcacaagtgtcgggggaatccgaggcaccagctctctctaccctcctgctcctctgctctctcctggtcctcctgtgtcctcatggctcatgagatggtgttgagatggctcccctggcctaggggatcacacagtgaacaaagcaggaagaaggcgaagggatgcccctctcctgtcacccttgtcccttacagcaagaagggcccagacgcccctctgcatactcccctggtgaactgctgcccaggactgggtcccccttttacccttgctgcatggagtccccagaagacaaacatctgtgtgtctgaaccctgagacaaaggcaggaaagggaaagagggaggcgagtggcttttgaggagggggctttagtatgagagctggaggatggaaccccatcagggggcccgggaaccactgagctgttaaaataaagtctgcaaacaaagaccagctgctggaagtgggtgtgccagggagtgcgcagagacacacggtgagaaaagaacaatggtaatgcttggagccgcccctaactgggatgggcctgaaatggtattgttattatttatagtatcattattagtcattttcatcttatttgtaccctccctctatctctcctctccaccttttcctaacattctatcaccagttttatgtcttccattagcaactttgtagctgtaaataatttacttacaactttcatataccctcagttgtacccagtatttcttaacttccctctttaaaaaaatgataatattaatcctccttctccttcgttcagtgcttcacatcccaactgctacctttgtgctttaaattttgtactaattggtgttgataacaagtatatttagttctcatatttatatgttgtgtatatgttttggtttttttttgtcttaaacaagagactactgagagccagtaagactgaaagaaagggcatcttcatatactgctagtttgagtgtgaattggtacaatttgcctgcagtgtggctctaggtataaagccttttgagttgttgatagcctctgacctgctcattctactcctacaaatatcttaaggaaataatctcaaatgtgggcaaagttttatgcgaagaaggatgttctttgtagcataatttatatgaggaattagaaacaccctgaggtccatcagctagggaaagacagcagaggggacagggcagcaccaggagggcttggcagccacagcaggggctgggctggcatctggcaagatccaggtctttgtgggacaaagaatcttagagaagcaacggggacacaggctgtccagtgcagcaccagtgaattcaccaagatgaagagttgagcacagagtgtgagacaaggatttgcaatgaggagtcatttaccatgagcgtgtatacatgactcaatattgtatatttaagggagtagagcacagtcattgaaaacatggggttgaagcagaagtcctggctctagcactattgtaaaaacactggcaagttccctaacttttgtggattcctctgtgtttgaatgggaaagtggtacccatctcctggcctgtgtgtgatcatcgaatgagacacatgtaagaggctctgcacatcgcagacatgcaatacacactggctatcaccagctagttatcacacatgctcccaggccctggtcattgtcagaaccttcctccccatctctatttctgtgtatagactctgtagtttctgtaatgatcagatggctgcccgtcctctgattatcttctcctcataccccaacaggatgagtgcacttttccttggtgtgggagtgagggcagaggaagctggagcgaggtgagtgtctgcaaatagcagatgatgggggctcagtgatagacaaacaatctggtttaggttggtcttggtgtttgcttccaccccagagagatttgcagagccccggctgctcaagcaagcctccctctgtccactggtggctcacatttgatcccacaatttgttttctcctcctcaagggtgcaacaaaacgttccaagtgggacagatactggagatcctcaaagtaagcccctcggtgactgggctgctggcaccatggacccaggtaggctcacctcctcttccctgctggttcctactcgcacttagaatggagggtggcacctccacagctgagtgagccccagaagaacccggatggactaggaggccaatgagtctgcccaaagcagcagaagaggtcacgtggagtcccccgacccaggggtctgggggtcatctgcatcctgacctctccttagggtgacacggcccaggtgcccacttcctccctaccctggcacctagcaaatgactcaagtggggcaggacatccttggggaagtggaatcagcgggggggggggggagtgtggggagagcagggtccaggaggagaggagggctgggagaggaggttgaccagcagccccgacctgtcacctcccgctctgctccaagctgaccctggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtaccatgagaataatatttccccatgttgtcttgaggatcaaatataacacggctacctggcctggccagtgcctgccacacaatagggcctccctaagggctggttcccatcccctctactggtcccctgttgattccaggtggaagccaccccgtccccccccagctgtgttagggcacccgccctgccctgcccatcacaagcacctgcttaccagggatgactgcctcaggcaggggctgagttcagtcatctaaaatacccccggtcaaagaaaaatctgaggcccaatagaattttaaagagttaattgagtaagaaaggattgctgaattgggaaacagcaaactggaggaggcttcgtgctatggtgaaaaagtgtcggagacaaggtttatcgggtgaatatgaaactgcagtaaggacattatttgattggttgcacttacaaaactgcctgtttgggtttaccttgttggaaaatccctggtcacgttggtgccagtgtgagtttagggaggtctccgaatacaggtgagaccggaacttagccttgcccaggtttttgatgctgaagagagaaaaaagtcaaagcaaaagcaaatcagcttttagtgcaaaacagaagtgcaggctcaggggtgggagtgcaggcggactcagaagagccagtcgggcccagtggagtttggggttcttgtctttgctggtttattaaattaaggtgtggagtaagcataaggatttctgggaagaggtggggatttcttggaattgggagggcaatgcagttttgtaccaaacatgggcatacatggaacggctgtggtgcgggtgggtgtggggtttagtgagacaaggagggtatgattgagtgtgaggcaaaacgtgggtcagacccagcgccgagttggatctcactggtcttagctgaattggccacttcctgtttgtcaggatcctgtgggcccatcccctccccctgtccctacaggtggtttcagcaactccttctgtgtctgtcatgtgaacctgctgcctggagttcttgtttcttctgtgacctcccagtatccacatctcagcatggccctctgtcagctggctttaagttttgtttgtatctaacagaagtacccatctgatatgaccccagttgagtttcccatagcttgcagtttcagggggttacagctgttctaaaggcctcgtaggtattgcctgtccaggaatgtttcagggctggtttttgttttaattttgcttttatatccaccagccccaccacatcaagaaatacacagatttagtgccagaggttccttccatccaaacctgggtttccttcctccttttggtgaagaaggaaaaagaaaaaacaagacaatcgctcgcccagccaagtcagcattgcgttcatttccctaagccccatttcctcaggagggcttcctccccttacagagttgccacggcaaccaagtcagctctgctcaggagccgccctggacagcaaactgggctgtgctgagtcctgtccaagacgaggggagggcagggaagattagaagccgagagcactcagccgaccccggaatccttacgaagggctgggctgggggactgaggaaaaactctccccccaaaacaagatgatctgtggtttaataacaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatagccccacaggtaagctataagggagaatgcagagaccacaggcattttcaaaacataaggagttttaatgttaaggagtttaaggagaatgtcaaagaaacattggccttggagtcaaatcctgagcttcctgcttgatggttttgggcggtgactctcgctgtctggattttactttcttcatctgtgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatccccccaaaaaaaagaatgaggtctcttgtgtgtgcacggcaagaaacaattttacatcatgcctcagtgcacacacaaatacatactggtccccagttccttatctgcaattccataattcccagatccctgcaaaccacacgttttggtggcagctgacttcaggagtaatcctgctctgtactgacttgagttctttgtagacctaccattattttttacatttaatgtgaatatttgcttgtttcactgttgaaacatgtgtgggtgtgattacagggagcagtccagcctctgctgggaatggtcaggaatataccatatgcaccccgtgtcctttctaaaatagtggaaattctgaatgcctaaacacatctggattccaggaatttacattaagggatatatatttgaaataacccacaaaaacaatactcacccctgctacgcttggtacactctgatattttcaaattgattttctttttaaaatgctgcttttgaaccaataatttcataacccaatgatgtgttgatattcacattttgaagacactggtataaagtgtttgacccaacaggcatgtggcagatggaagtgatcactgggatgtttccacttccttggcctggaaggctcacttcatgttggtgctgagctgaaaaggattcattcctctccaaagcaccatggcactcccctggtgtttcaatgttctcaggctgccatagtaaaatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctcacacagtcttcttgtgtccctttctgttcttacaataggacactagccctctaatagaattagagccctacccttgtgatctcattcagtcttaattgcttccttaaaggccagatctccaaatgtagtcacctgagtttaaagcttcagcatatgaattttgggggcacacaattccctctatagcactaatgactccataaaacaagtcccacatcacagctgtccaggaaaattaacatgtagtcatctcttatgcaatggctgttatgcactcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggtaagctccatggggttacctccattgggcactccggcgatgccacccagctctcccctgggctagttttccctgacaggcacacctcctccaggcagccccctctgctgggcttgaggatgaccttcttggcactccaggaagaatatttcctccatgtccttcgctggcagtgagtagcctcaggctgaggggataggaagcccacaggaacagggtcatttctgccatctgctggtgatgggaactttgccagttactttctcactttcagcctttcttcatcaatggagttttattgtgagaaaaatgagatcgtgcatgtaaagtgcttagcataatgactgacacacagtaggtgcacagttaacgttaacatcttacaagcttggtggaaacagaaccagggttaaggatcttcttcttgaagatgggagcccagcaggacttgacctttgggacaagtcagaaaaatcctgacctaaccaatgtgtgttcctggggatgctggctggagccctttttctcatctgaggaattccataaacacggcaggacccttctgctggtccaggatgccgagaggctggagtggagttgcacagcgctgggtctctttccagctctgtctgtgtccagtccctgggctctgggcttatgtcagagactggaaactgtcatcagtctaataggaatagcaactcaatgtgataggagtgtggtgaaggccttagaggcaactccaggtcaaaggtggggaaccaacaccaagatcctgcccaaaggcccagagagaccgggatcagcgtcagagcctggagtcaggatggagcaagagtcagccttggttgtaggacaagcaggaaggctggggcaccagggctgggactagggtgtggaaagagaggcaccaagggcttgaaacttaaggaggtcatgaacttgcagaggacatgtgagtgggagagggatatttcttccctgtctggatgatcccaacactcatgggcatatagggtcatggttgcctgtgtctctcacaccacgccttggaactggcaagttctgggctaccctttgagaccttcttctcttctacacagagaaacccctgacattgacaagcagtatgtcttagtgaccattttcatagtagaattagttgctgccaatttgtgtaatttcagggatactgagcagactcacaacttcccaaccaaggaggaaaacacttcctctaccatcttgtccaaattcaggtcttttcagcattagcaatttatataggtggttctgaaagtgttttgaatcttctagaggttccataaaattgcaaatggccttggtgtgcacacaggtgaagctgtcactactaaggcatcagttaggctggtgacacctgcgagtgagacctggaaggttgggggtgcaggtggtaggtcaggaggcagtaaggtggctggagcgtccatgtggagccagaatgaatagccagatctcccactccagtcagctggggcagtggccagaaccagtagccttcagccaggtgaaagggcatgaggcattggaagggagcagatgccaggcaaagtgaactcctgtctctccggggttttgtttttgtttgaattcaaagtactcagagatagccagactgcaatgtctgagggcacccttacctttgacaccacctgcaaatttaaggggatttctaaatccatcctttgattttgtaattcactggaaggactcacataactcactgaaaactgctatttcacaattgtggttgatcacacggaaagaacacagattaaaatcagcctaagaaagagacacacggggcagagtttgggagggttttaagtgtgaagcttcattgtcctcaggacgctgtgttctcctgtgtgaatgtgggacaaaacacatgcggtgttgccaaccagggaagctcacccagttaaggaaaaattcctgtgaatcacattaaaccagaaatgaagccttttttcaggattgttgttacaggggagggagactgagcccagctccaaatatagtaaagacagagggggagtcacagccaacaccagggtgggggcgggagatggaacaggactgataggagacaccagagtggggggttcctgctaaattggcctaacaggattctcactaaaggcaggtcagacactcacccatcaatggtgggggtgaagagcataatcagatagcaaagcgtaatcagacagcaaggggggaagaccctccctaaactgacttggggagattcttgctgagctgggtggtgcaggtccagcaagcagtgggtggctgtggaaggccaaggtcggcgcctagtggagaagaggctcagaagagcccagctggagttggtcaaggagaaagtccttctttctcaacccatgccttagtgtccagagtatctgctggggctggatcacaagctgccctcatggctgacctggagtctccagcccctccctgaggtctaacccctttagtccccgggtcctctgggatcaggaaagacaccaaatagccccaaaccccatcatccatcagattcctatacggtcccgtggccaaatcaccaggcaaagacagatgttcctaccaggcaggacattccaggggcctggagatcacttcccaggagctgaggacaaagggaaggcctctctttgggtaaagttcatgcttcactttcctgccatcctgggaataaggtctctttgtctcactctcactgctctttgttcatctgcagagttttccctctccaaacactttggcagtcacggtgttgacctgcccttgaatgaggaggcatctttatcaaacacctaccatgaaagagcatctgagatgcctttaagatatttatttccatatggaataaatattgaggagtatctatgatgaacaaaatgtgtttgagtttgaaagataattaattccatttgtaaaatttgtttctatttgatcgatagtgaaagctctgcaatttacacaggatagagatcacatggagctcatttcacagacagggaaactgcatttcttttttttttttttttttttgagttggagtcttgctctgtcgcccaagctggagtgcagtggcgcgatctcggctcactgcaagctctgcctcccggttcaagcaattctcctgcctcagcctcctgagtagctgggactacaggcgcccaccaccacgcccggctaattttttgaatttttggtagagacagggtttcaccgtattagtcaggatggtctcaatctcctgaccttgtgatccacccgccttggcctcccaaagtgctgggattacaggtgtgagccaccacaccgagccaaaactgcatttcttaatcctttaacctttccttgtgcaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaatggtggtgatggtggttgtgatggcagcagagtggtgggggccttggcaagtggtcggtgctcttccagaccaggggacaccgatggaccgatgaagttccaggggaacttgaagtgctgtgttggaaagaggttaatttgggaagaaaggaaaaatgaaaggagatgccaggaacaggtcaaggaaccttgaggtgtgtccaggagttcaaccccgcttgtggtcacgagacctcgcctctctgagcctcagtttcctcatcagctgtagaagggtacctggacaaggtgatgtctcaggtccacccagctctccccatcttgtgtcctggagacttgggtccaatcagcactgactgatggctgtgcctttgtggtgccgatggaggctcccctgggctctgggtgcctgacttcccttcctcatgatccttcttccagggtctcgggaaacgaggcttccatggcccctcctgcttgctcactggactctcactttcccagctggtcatttccctgagacctcaaaaccccaccaaccccactggggcacccacagaaagcttgtacatgtctggctctggctgagcacaggtgtggtttccatctgcgagtcagagcccgggattgacatgggacgctcgaggctgactagtgtcagaggggcctgtgtgcagattgggagaagattatcgagtaatagaggggcaaagagggacatccagacagcaaacacccccatccagtctgtcctcacgttttgcccagactcctgcaagaacttccagaatggtcttccatgtgcaactgcccgtccctgcccatgtcctggatcattctccacactgcgccaggttgggctttaacaagatcatgttttgggtttttgggggttttttgtttgtttgtttggtctcactctgttgtgaggctggcgtcccgtggcatgagcatggctcactgcatcttggacctcccggcctcaaactacccttccaccttgaccccctgagtagctgggaccatccgtgtgtgccacattgcccaggctggtctcaaactcctgagttcaggtgatctgttcgccttggcattccaatgggctgcaattacagacacgagccaccgtgcccacctaagaacatagatttgatcgagcacccacttctgaccattcaatggcttcccattactcttagcacaaagatgtaggccatgatgctgcctaaagtagcctgttgcggcctggggtcctgtgaaggaagagccagaggcaacgttctggtgcagagggtttctaggaagtgattctaggagcagaactgaggatccaggagggaaggaggaaacgttgatacaagaagtttttgaatgggccatccatatgggcaatgagaccttctgaggtgccttcaaggagcgtcctcagaatctttgtttccagggaggagacatggaggcctttatccactgctttagctgtgtcccaggggttctggtacattgtgtctttgttctcattggtttcaaagaacttcttgatttctgccttaattttgttatttacccagtaatcattcaggaacacgttgttcaatttccatgtagttgtgcggtttttagtgagtttcttaatcctgagttctaatttgattgcactgtggtctgagacactgtttgttatgatttccattcttttgcatttgctgaggaatgttttacttccaattatgtggtcgactttagaataagtgttatacggtgctgagaagaaagtatattctgttgatttgggacggagagttctgtagatgtctgttaggtccactcagtccagggctgagttcaagtcctgaacatccttgttaattttctgtctcgttgacctgtctaatattgacagtggggtgttaaagtctcccactgctattgtgtgggagtctaagtctctttgtaggtctctaagaacttgttttatgaatctgcgtgctcccgtattgggtgcatatatatttaggatagttagctcttcttgttgcactgatgtttgttggtttaaaagatcttttttgatctttgttggtttaaagtctgttttatcagagactaggattgcaacccctgcttttttgtttgtttgtttgtttgtttgttttgctttccatttgcttggtaaatgttcctccatccctttattttcagcctatgtgtgtttttgcacatgagatgggtctcctgaatacagtacatcaacgggtcttgactttatccaatttgccagtctgtctgttttaattggggcatttagcccatttacatttaaggttcatattgttatgtgtgaatttgatcctgtcatcatgatgctagctgattattttgcacattagttgatgcagtttcttcatggtatcattggtctttatattttggtgtggttttgcagtgtctggtactggtttttcctttccatatttagtgcttccttcaggagctcatgtaaggccggcctggtggtgacaaaatccctcagcatttgcttgtctggaaaggattttatttctcctttgcttatgaagcttagtttggctggatatgaaattctgggttgaaaattcttttctttaagaatgttgaatattggtccccactctcttccagcttatatagggtttctgcagagagatccactgttagtctgatgggcttcccttcgtaggtaacgtgatctttctctctggctgcccttaacattttttccttcgtttcaaccttggagaatctgatgattatgtgtcttggggttgctcttcttgaagagtatcttagtggtgttctctgtatttcctgaatttgaatgttggcctggcttgctggttggggaagttctcctggataatatcctaaagtgtgttttccagcttgtttccgttctccccatcactttcaggtacaccaatcaattgtaggtttaatcttttcacatagtcccatatttcttggaggctttatttgttccattgtcattcttttttctctaattttgtcttcacacattgtttcagtaagttgatcttcaatctttgatattccgcttgatcaatttggctattgatagttgtgtatccttcacgaagttctcatgctgtgtttttcagctccatcaggtcatttacgttcttctctaaactggttattctagttagcagctcctgtaacctttcatcaaggttcttagcttccttgcattgggttacaacatgctcctttagctcagaggagtttctcattacccatcttctgaagcctacttctgtcaattcgtcaaattcattctccatccagttttgtgcccttgctggagaggagttgcaatcatttggagaagagacat

SEQ ID NO: 10 - DNA, 23 bp, synthetic construct
  misc_feature 1..23: note = Primer
  source 1..23: mol_type = other DNA
gctactcctgctgactgataatg

SEQ ID NO: 11 - DNA, 21 bp, synthetic construct
  misc_feature 1..21: note = Primer
  source 1..21: mol_type = other DNA
aaggttgtccagagctttacg

SEQ ID NO: 12 - DNA, 23 bp, synthetic construct
  misc_feature 1..23: note = Probe
  source 1..23: mol_type = other DNA
tgcccaggaatgaggcagatgag

SEQ ID NO: 13 - DNA, 16 bp, synthetic construct
  misc_feature 1..16: note = Synthetic oligonucleotide
  source 1..16: mol_type = other DNA
gttcaaaagcagcatt

SEQ ID NO: 14 - DNA, 16 bp, synthetic construct
  misc_feature 1..16: note = Synthetic oligonucleotide
  source 1..16: mol_type = other DNA
aagatataccgaggaa

SEQ ID NO: 15 - DNA, 16 bp, synthetic construct
  misc_feature 1..16: note = Synthetic oligonucleotide
  source 1..16: mol_type = other DNA
tcccctggcagagact

SEQ ID NO: 16 - DNA, 16 bp, synthetic construct
  misc_feature 1..16: note = Synthetic oligonucleotide
  source 1..16: mol_type = other DNA
tcgctccagcttcctc

SEQ ID NO: 17 - DNA, 16 bp, synthetic construct
  misc_feature 1..16: note = Synthetic oligonucleotide
  source 1..16: mol_type = other DNA
ttactttgaggatctc

SEQ ID NO: 18 - DNA, 16 bp, synthetic construct
  misc_feature 1..16: note = Synthetic oligonucleotide
  source 1..16: mol_type = other DNA
actgctggcctttatc

SEQ ID NO: 19 - DNA, 16 bp, synthetic construct
  misc_feature 1..16: note = Synthetic oligonucleotide
  source 1..16: mol_type = other DNA
ggagccttcttatgtt

SEQ ID NO: 20 - DNA, 16 bp, synthetic construct
  misc_feature 1..16: note = Synthetic oligonucleotide
  source 1..16: mol_type = other DNA
ggtgcctttgtggacc

SEQ ID NO: 21 - DNA, 16 bp, synthetic construct
  misc_feature 1..16: note = Synthetic oligonucleotide
  source 1..16: mol_type = other DNA
agacccatgccgacga

SEQ ID NO: 22 - DNA, 16 bp, synthetic construct
  misc_feature 1..16: note = Synthetic oligonucleotide
  source 1..16: mol_type = other DNA
agcggctgtgattccc

SEQ ID NO: 23 - DNA, 16 bp, synthetic construct
  misc_feature 1..16: note = Synthetic oligonucleotide
  source 1..16: mol_type = other DNA
ctttccgtagtccatg

SEQ ID NO: 24 - DNA, 16 bp, synthetic construct
  misc_feature 1..16: note = Synthetic oligonucleotide
  source 1..16: mol_type = other DNA
acccaaaaactccctc

SEQ ID NO: 25 - DNA, 16 bp, synthetic construct
  misc_feature 1..16: note = Synthetic oligonucleotide
  source 1..16: mol_type = other DNA
gcacggatgtccttcc

SEQ ID NO: 26 - DNA, 16 bp, synthetic construct
  misc_feature 1..16: note = Synthetic oligonucleotide
  source 1..16: mol_type = other DNA
gattggctcagtgacc

SEQ ID NO: 27 - DNA, 16 bp, synthetic construct
  misc_feature 1..16: note = Synthetic oligonucleotide
  source 1..16: mol_type = other DNA
tgggttcattaaccct

SEQ ID NO: 28 - DNA, 16 bp, synthetic construct
  misc_feature 1..16: note = Synthetic oligonucleotide
  source 1..16: mol_type = other DNA
acgaggtagactacat

SEQ ID NO: 29 - DNA, 16 bp, synthetic construct
  misc_feature 1..16: note = Synthetic oligonucleotide
  source 1..16: mol_type = other DNA
ttcttggtccgcctgc

SEQ ID NO: 30 - DNA, 16 bp, synthetic construct
  misc_feature 1..16: note = Synthetic oligonucleotide
  source 1..16: mol_type = other DNA
aatgtttgcatttggg

SEQ ID NO: 31 - DNA, 16 bp, synthetic construct
  misc_feature 1..16: note = Synthetic oligonucleotide
  source 1..16: mol_type = other DNA
gtgctcagctatggaa

SEQ ID NO: 32 - DNA, 16 bp, synthetic construct
  misc_feature 1..16: note = Synthetic oligonucleotide
  source 1..16: mol_type = other DNA
tagtctaaagtaaact

SEQ ID NO: 33 - DNA, 16 bp, synthetic construct
  misc_feature 1..16: note = Synthetic oligonucleotide
  source 1..16: mol_type = other DNA
gctggttccttcaagc

SEQ ID NO: 34 - DNA, 16 bp, synthetic construct
  misc_feature 1..16: note = Synthetic oligonucleotide
  source 1..16: mol_type = other DNA
cattcttcggaggaca

SEQ ID NO: 35 - DNA, 16 bp, synthetic construct
  misc_feature 1..16: note = Synthetic oligonucleotide
  source 1..16: mol_type = other DNA
tcaggaagccgctgcc

SEQ ID NO: 36 - DNA, 16 bp, synthetic construct
  misc_feature 1..16: note = Synthetic oligonucleotide
  source 1..16: mol_type = other DNA
acctgcccttcagtgt

SEQ ID NO: 37 - DNA, 16 bp, synthetic construct
  misc_feature 1..16: note = Synthetic oligonucleotide
  source 1..16: mol_type = other DNA
ctgtttacttaccggg

SEQ ID NO: 38 - DNA, 16 bp, synthetic construct
  misc_feature 1..16: note = Synthetic oligonucleotide
  source 1..16: mol_type = other DNA
tcaatcctgggcggcg

SEQ ID NO: 39 - DNA, 16 bp, synthetic construct
  misc_feature 1..16: note = Synthetic oligonucleotide
  source 1..16: mol_type = other DNA
catgattgcaaagctg

SEQ ID NO: 40 - DNA, 16 bp, synthetic construct
  misc_feature 1..16: note = Synthetic oligonucleotide
  source 1..16: mol_type = other DNA
gctttgtgaacccatc

SEQ ID NO: 41 - DNA, 16 bp, synthetic construct
  misc_feature 1..16: note = Synthetic oligonucleotide
  source 1..16: mol_type = other DNA
caagcccagtccaatt

SEQ ID NO: 42 - DNA, 16 bp, synthetic construct
  misc_feature 1..16: note = Synthetic oligonucleotide
  source 1..16: mol_type = other DNA
gatgtttgtcttctgg

SEQ ID NO: 43 - DNA, 16 bp, synthetic construct
  misc_feature 1..16: note = Synthetic oligonucleotide
  source 1..16: mol_type = other DNA
gccagtgtgtattgca

SEQ ID NO: 44 - DNA, 16 bp, synthetic construct
  misc_feature 1..16: note = Synthetic oligonucleotide
  source 1..16: mol_type = other DNA
acaaattgtgggatca

SEQ ID NO: 45 - DNA, 16 bp, synthetic construct
  misc_feature 1..16: note = Synthetic oligonucleotide
  source 1..16: mol_type = other DNA
ctaggtgccagggtag

SEQ ID NO: 46 - DNA, 16 bp, synthetic construct
  misc_feature 1..16: note = Synthetic oligonucleotide
  source 1..16: mol_type = other DNA
ccccccccccgctgat

SEQ ID NO: 47 - DNA, 16 bp, synthetic construct
  misc_feature 1..16: note = Synthetic oligonucleotide
  source 1..16: mol_type = other DNA
gggccactcagagcaa

SEQ ID NO: 48 - DNA, 16 bp, synthetic construct
  misc_feature 1..16: note = Synthetic oligonucleotide
  source 1..16: mol_type = other DNA
gtggcaaaggacagac

SEQ ID NO: 49 - DNA, 16 bp, synthetic construct
  misc_feature 1..16: note = Synthetic oligonucleotide
  source 1..16: mol_type = other DNA
ccctattgtgtggcag

SEQ ID NO: 50 - DNA, 16 bp, synthetic construct
  misc_feature 1..16: note = Synthetic oligonucleotide
  source 1..16: mol_type = other DNA
tttttctttgaccggg

SEQ ID NO: 51 - DNA, 16 bp, synthetic construct
  misc_feature 1..16: note = Synthetic oligonucleotide
  source 1..16: mol_type = other DNA
cgaagcctcctccagt

SEQ ID NO: 52 - DNA, 16 bp, synthetic construct
  misc_feature 1..16: note = Synthetic oligonucleotide
  source 1..16: mol_type = other DNA
cacccgataaaccttg

SEQ ID NO: 53 - DNA, 16 bp, synthetic construct
  misc_feature 1..16: note = Synthetic oligonucleotide
  source 1..16: mol_type = other DNA
aggcagttttgtaagt

SEQ ID NO: 54 - DNA, 16 bp, synthetic construct
  misc_feature 1..16: note = Synthetic oligonucleotide
  source 1..16: mol_type = other DNA
attcggagacctccct

SEQ ID NO: 55 - DNA, 16 bp, synthetic construct
  misc_feature 1..16: note = Synthetic oligonucleotide
  source 1..16: mol_type = other DNA
cctgggcaaggctaag

SEQ ID NO: 56 - DNA, 16 bp, synthetic construct
  misc_feature 1..16: note = Synthetic oligonucleotide
  source 1..16: mol_type = other DNA
ttactccacaccttaa

SEQ ID NO: 57 - DNA, 16 bp, synthetic construct
  misc_feature 1..16: note = Synthetic oligonucleotide
  source 1..16: mol_type = other DNA
tttggtacaaaactgc

SEQ ID NO: 58 - DNA, 16 bp, synthetic construct
  misc_feature 1..16: note = Synthetic oligonucleotide
  source 1..16: mol_type = other DNA
tgtctcactaaacccc

SEQ ID NO: 59 - DNA, 16 bp, synthetic construct
  misc_feature 1..16: note = Synthetic oligonucleotide
  source 1..16: mol_type = other DNA
gaccagtgagatccaa

SEQ ID NO: 60 - DNA, 16 bp, synthetic construct
  misc_feature 1..16: note = Synthetic oligonucleotide
  source 1..16: mol_type = other DNA
accacctgtagggaca

SEQ ID NO: 61 - DNA, 16 bp, synthetic construct
  misc_feature 1..16: note = Synthetic oligonucleotide
  source 1..16: mol_type = other DNA
gggtacttctgttaga

SEQ ID NO: 62 - DNA, 16 bp, synthetic construct
  misc_feature 1..16: note = Synthetic oligonucleotide
  source 1..16: mol_type = other DNA
cagctgtaaccccctg

SEQ ID NO: 63 - DNA, 16 bp, synthetic construct
  misc_feature 1..16: note = Synthetic oligonucleotide
  source 1..16: mol_type = other DNA
cagccctgaaacattc

SEQ ID NO: 64 - DNA, 16 bp, synthetic construct
  misc_feature 1..16: note = Synthetic oligonucleotide
  source 1..16: mol_type = other DNA
gcgattgtcttgtttt

SEQ ID NO: 65 - DNA, 16 bp, synthetic construct
  misc_feature 1..16: note = Synthetic oligonucleotide
  source 1..16: mol_type = other DNA
gccgtggcaactctgt

SEQ ID NO: 66 - DNA, 16 bp, synthetic construct
  misc_feature 1..16: note = Synthetic oligonucleotide
  source 1..16: mol_type = other DNA
gggtcggctgagtgct

SEQ ID NO: 67 - DNA, 16 bp, synthetic construct
  misc_feature 1..16: note = Synthetic oligonucleotide
  source 1..16: mol_type = other DNA
acctccatgttgcctc

SEQ ID NO: 68 - DNA, 16 bp, synthetic construct
  misc_feature 1..16: note = Synthetic oligonucleotide
  source 1..16: mol_type = other DNA
gctggtcttgggcact

SEQ ID NO: 69 - DNA, 16 bp, synthetic construct
  misc_feature 1..16: note = Synthetic oligonucleotide
  source 1..16: mol_type = other DNA
cttatagcttacctgt

SEQ ID NO: 70 - DNA, 16 bp, synthetic construct
  misc_feature 1..16: note = Synthetic oligonucleotide
  source 1..16: mol_type = other DNA
gagtcaccgcccaaaa

SEQ ID NO: 71 - DNA, 16 bp, synthetic construct
  misc_feature 1..16: note = Synthetic oligonucleotide
  source 1..16: mol_type = other DNA
ttgccgtgcacacaca

SEQ ID NO: 72 - DNA, 16 bp, synthetic construct
  misc_feature 1..16: note = Synthetic oligonucleotide
  source 1..16: mol_type = other DNA
gtttgcagggatctgg

SEQ ID NO: 73 - DNA, 16 bp, synthetic construct
  misc_feature 1..16: note = Synthetic oligonucleotide
  source 1..16: mol_type = other DNA
caaagaactcaagtca

SEQ ID NO: 74 - DNA, 16 bp, synthetic construct
  misc_feature 1..16: note = Synthetic oligonucleotide
  source 1..16: mol_type = other DNA
actgctccctgtaatc

SEQ ID NO: 75 - DNA, 16 bp, synthetic construct
  misc_feature 1..16: note = Synthetic oligonucleotide
  source 1..16: mol_type = other DNA
tgtgtttaggcattca

SEQ ID NO: 76 - DNA, 16 bp, synthetic construct
  misc_feature 1..16: note = Synthetic oligonucleotide
  source 1..16: mol_type = other DNA
gttatgaaattattgg

SEQ ID NO: 77 - DNA, 16 bp, synthetic construct
  misc_feature 1..16: note = Synthetic oligonucleotide
  source 1..16: mol_type = other DNA
atgcctgttgggtcaa

SEQ ID NO: 78 - DNA, 16 bp, synthetic construct
  misc_feature 1..16: note = Synthetic oligonucleotide
  source 1..16: mol_type = other DNA
gcaccaacatgaagtg

SEQ ID NO: 79 - DNA, 16 bp, synthetic construct
  misc_feature 1..16: note = Synthetic oligonucleotide
  source 1..16: mol_type = other DNA
acccttttggcacctt

SEQ ID NO: 80 - DNA, 16 bp, synthetic construct
  misc_feature 1..16: note = Synthetic oligonucleotide
  source 1..16: mol_type = other DNA
ttctattagagggcta

SEQ ID NO: 81 - DNA, 16 bp, synthetic construct
  misc_feature 1..16: note = Synthetic oligonucleotide
  source 1..16: mol_type = other DNA
gctttaaactcaggtg

SEQ ID NO: 82 - DNA, 16 bp, synthetic construct
  misc_feature 1..16: note = Synthetic oligonucleotide
  source 1..16: mol_type = other DNA
gttttatggagtcatt

SEQ ID NO: 83 - DNA, 16 bp, synthetic construct
  misc_feature 1..16: note = Synthetic oligonucleotide
  source 1..16: mol_type = other DNA
gtgcataacagccatt

SEQ ID NO: 84 - DNA, 16 bp, synthetic construct
  misc_feature 1..16: note = Synthetic oligonucleotide
  source 1..16: mol_type = other DNA
agatataccgaggaat

SEQ ID NO: 85 - DNA, 16 bp, synthetic construct
  misc_feature 1..16: note = Synthetic oligonucleotide
  source 1..16: mol_type = other DNA
ggatcccacctccagt

SEQ ID NO: 86 - DNA, 16 bp, synthetic construct
  misc_feature 1..16: note = Synthetic oligonucleotide
  source 1..16: mol_type = other DNA
actcccacaccaagga

SEQ ID NO: 87 - DNA, 16 bp, synthetic construct
  misc_feature 1..16: note = Synthetic oligonucleotide
  source 1..16: mol_type = other DNA
tactttgaggatctcc

SEQ ID NO: 88 - DNA, 16 bp, synthetic construct
  misc_feature 1..16: note = Synthetic oligonucleotide
  source 1..16: mol_type = other DNA
ctgctggcctttatcg

SEQ ID NO: 89 - DNA, 16 bp, synthetic construct
  misc_feature 1..16: note = Synthetic oligonucleotide
  source 1..16: mol_type = other DNA
gagccttcttatgtta

SEQ ID NO: 90 - DNA, 16 bp, synthetic construct
  misc_feature 1..16: note = Synthetic oligonucleotide
  source 1..16: mol_type = other DNA
gtgcctttgtggacct

SEQ ID NO: 91 - DNA, 16 bp, synthetic construct
  misc_feature 1..16: note = Synthetic oligonucleotide
  source 1..16: mol_type = other DNA
gacccatgccgacgag

SEQ ID NO: 92 - DNA, 16 bp, synthetic construct
  misc_feature 1..16: note = Synthetic oligonucleotide
  source 1..16: mol_type = other DNA
gcggctgtgattccca

SEQ ID NO: 93 - DNA, 16 bp, synthetic construct
  misc_feature 1..16: note = Synthetic oligonucleotide
  source 1..16: mol_type = other DNA
tttccgtagtccatgg

SEQ ID NO: 94 - DNA, 16 bp, synthetic construct
  misc_feature 1..16: note = Synthetic oligonucleotide
  source 1..16: mol_type = other DNA
acctccttcaatttgt

SEQ ID NO: 95 - DNA, 16 bp, synthetic construct
  misc_feature 1..16: note = Synthetic oligonucleotide
  source 1..16: mol_type = other DNA
cacggatgtccttccc

SEQ ID NO: 96 - DNA, 16 bp, synthetic construct
  misc_feature 1..16: note = Synthetic oligonucleotide
  source 1..16: mol_type = other DNA
attggctcagtgaccc

SEQ ID NO: 97 - DNA, 16 bp, synthetic construct
  misc_feature 1..16: note = Synthetic oligonucleotide
  source 1..16: mol_type = other DNA
gggttcattaaccctc

SEQ ID NO: 98 - DNA, 16 bp, synthetic construct
  misc_feature 1..16: note = Synthetic oligonucleotide
  source 1..16: mol_type = other DNA
cgaggtagactacatc

SEQ ID NO: 99 - DNA, 16 bp, synthetic construct
  misc_feature 1..16: note = Synthetic oligonucleotide
  source 1..16: mol_type = other DNA
tcttggtccgcctgca

SEQ ID NO: 100 - DNA, 16 bp, synthetic construct
  misc_feature 1..16: note = Synthetic oligonucleotide
  source 1..16: mol_type = other DNA
tgtttgcatttgggtc

SEQ ID NO: 101 - DNA, 16 bp, synthetic construct
  misc_feature 1..16: note = Synthetic oligonucleotide
  source 1..16: mol_type = other DNA
tgctcagctatggaaa

SEQ ID NO: 102 - DNA, 16 bp, synthetic construct
  misc_feature 1..16: note = Synthetic oligonucleotide
  source 1..16: mol_type = other DNA
agtctaaagtaaactg

SEQ ID NO: 103 - DNA, 16 bp, synthetic construct
  misc_feature 1..16: note = Synthetic oligonucleotide
  source 1..16: mol_type = other DNA
ctggttccttcaagcc

SEQ ID NO: 104 - DNA, 16 bp, synthetic construct
  misc_feature 1..16: note = Synthetic oligonucleotide
  source 1..16: mol_type = other DNA
attcttcggaggacat

SEQ ID NO: 105 - DNA, 16 bp, synthetic construct
  misc_feature 1..16: note = Synthetic oligonucleotide
  source 1..16: mol_type = other DNA
aggaagccgctgcctg

SEQ ID NO: 106 - DNA, 16 bp, synthetic construct
  misc_feature 1..16: note = Synthetic oligonucleotide
  source 1..16: mol_type = other DNA
tgcccttcagtgttca

SEQ ID NO: 107 - DNA, 16 bp, synthetic construct
  misc_feature 1..16: note = Synthetic oligonucleotide
  source 1..16: mol_type = other DNA
tgtttacttaccgggt

SEQ ID NO: 108 - DNA, 16 bp, synthetic construct
  misc_feature 1..16: note = Synthetic oligonucleotide
  source 1..16: mol_type = other DNA
caatcctgggcggcga

SEQ ID NO: 109 - DNA, 16 bp, synthetic construct
  misc_feature 1..16: note = Synthetic oligonucleotide
  source 1..16: mol_type = other DNA
atgattgcaaagctgg

SEQ ID NO: 110 - DNA, 16 bp, synthetic construct
  misc_feature 1..16: note = Synthetic oligonucleotide
  source 1..16: mol_type = other DNA
aacccatctgagctgt

SEQ ID NO: 111 - DNA, 16 bp, synthetic construct
  misc_feature 1..16: note = Synthetic oligonucleotide
  source 1..16: mol_type = other DNA
gcccagtccaattgtg

SEQ ID NO: 112 - DNA, 16 bp, synthetic construct
  misc_feature 1..16: note = Synthetic oligonucleotide
  source 1..16: mol_type = other DNA
actccatgcagcaagg

SEQ ID NO: 113 - DNA, 16 bp, synthetic construct
  misc_feature 1..16: note = Synthetic oligonucleotide
  source 1..16: mol_type = other DNA
gtctgcgatgtgcaga

SEQ ID NO: 114 - DNA, 16 bp, synthetic construct
  misc_feature 1..16: note = Synthetic oligonucleotide
  source 1..16: mol_type = other DNA
tgtgggatcaaatgtg

SEQ ID NO: 115 - DNA, 16 bp, synthetic construct
  misc_feature 1..16: note = Synthetic oligonucleotide
  source 1..16: mol_type = other DNA
taggtgccagggtagg

SEQ ID NO: 116 - DNA, 16 bp, synthetic construct
  misc_feature 1..16: note = Synthetic oligonucleotide
  source 1..16: mol_type = other DNA
cccccccccgctgatt

SEQ ID NO: 117 - DNA, 16 bp, synthetic construct
  misc_feature 1..16: note = Synthetic oligonucleotide
  source 1..16: mol_type = other DNA
ggccactcagagcaaa

SEQ ID NO: 118 - DNA, 16 bp, synthetic construct
  misc_feature 1..16: note = Synthetic oligonucleotide
  source 1..16: mol_type = other DNA
ggcaaaggacagaccg

SEQ ID NO: 119 - DNA, 16 bp, synthetic construct
  misc_feature 1..16: note = Synthetic oligonucleotide
  source 1..16: mol_type = other DNA
ccaggccaggtagccg

SEQ ID NO: 120 - DNA, 16 bp, synthetic construct
  misc_feature 1..16: note = Synthetic oligonucleotide
  source 1..16: mol_type = other DNA
gggtattttagatgac

SEQ ID NO: 121 - DNA, 16 bp, synthetic construct
  misc_feature 1..16: note = Synthetic oligonucleotide
  source 1..16: mol_type = other DNA
gaagcctcctccagtt

SEQ ID NO: 122 - DNA, 16 bp, synthetic construct
  misc_feature 1..16: note = Synthetic oligonucleotide
  source 1..16: mol_type = other DNA
acccgataaaccttgt

SEQ ID NO: 123 - DNA, 16 bp, synthetic construct
  misc_feature 1..16: note = Synthetic oligonucleotide
  source 1..16: mol_type = other DNA
ggcagttttgtaagtg

SEQ ID NO: 124 - DNA, 16 bp, synthetic construct
  misc_feature 1..16: note = Synthetic oligonucleotide
  source 1..16: mol_type = other DNA
ttcggagacctcccta

SEQ ID NO: 125 - DNA, 16 bp, synthetic construct
  misc_feature 1..16: note = Synthetic oligonucleotide
  source 1..16: mol_type = other DNA
ctgggcaaggctaagt

SEQ ID NO: 126 - DNA, 16 bp, synthetic construct
  misc_feature 1..16: note = Synthetic oligonucleotide
  source 1..16: mol_type = other DNA
tactccacaccttaat

SEQ ID NO: 127 - DNA, 16 bp, synthetic construct
  misc_feature 1..16: note = Synthetic oligonucleotide
  source 1..16: mol_type = other DNA
ttggtacaaaactgca

SEQ ID NO: 128 - DNA, 16 bp, synthetic construct
  misc_feature 1..16: note = Synthetic oligonucleotide
  source 1..16: mol_type = other DNA
gtctcactaaacccca

SEQ ID NO: 129 - DNA, 16 bp, synthetic construct
  misc_feature 1..16: note = Synthetic oligonucleotide
  source 1..16: mol_type = other DNA
accagtgagatccaac

SEQ ID NO: 130 - DNA, 16 bp, synthetic construct
  misc_feature 1..16: note = Synthetic oligonucleotide
  source 1..16: mol_type = other DNA
ggatgggcccacagga

SEQ ID NO: 131 - DNA, 16 bp, synthetic construct
  misc_feature 1..16: note = Synthetic oligonucleotide
  source 1..16: mol_type = other DNA
ggtacttctgttagat

SEQ ID NO: 132 - DNA, 16 bp, synthetic construct
  misc_feature 1..16: note = Synthetic oligonucleotide
  source 1..16: mol_type = other DNA
agctgtaaccccctga

SEQ ID NO: 133 - DNA, 16 bp, synthetic construct
  misc_feature 1..16: note = Synthetic oligonucleotide
  source 1..16: mol_type = other DNA
agccctgaaacattcc

SEQ ID NO: 134 - DNA, 16 bp, synthetic construct
  misc_feature 1..16: note = Synthetic oligonucleotide
  source 1..16: mol_type = other DNA
cgattgtcttgttttt

SEQ ID NO: 135 - DNA, 16 bp, synthetic construct
  misc_feature 1..16: note = Synthetic oligonucleotide
  source 1..16: mol_type = other DNA
ccgtggcaactctgta

SEQ ID NO: 136 - DNA, 16 bp, synthetic construct
  misc_feature 1..16: note = Synthetic oligonucleotide
  source 1..16: mol_type = other DNA
gtcggctgagtgctct

SEQ ID NO: 137 - DNA, 16 bp, synthetic construct
  misc_feature 1..16: note = Synthetic oligonucleotide
  source 1..16: mol_type = other DNA
ccatgttgcctctgtc

SEQ ID NO: 138 - DNA, 16 bp, synthetic construct
  misc_feature 1..16: note = Synthetic oligonucleotide
  source 1..16: mol_type = other DNA
ctggtcttgggcactc

SEQ ID NO: 139 - DNA, 16 bp, synthetic construct
  misc_feature 1..16: note = Synthetic oligonucleotide
  source 1..16: mol_type = other DNA
tatagcttacctgtgg

SEQ ID NO: 140 - DNA, 16 bp, synthetic construct
  misc_feature 1..16: note = Synthetic oligonucleotide
  source 1..16: mol_type = other DNA
gtcaccgcccaaaacc

SEQ ID NO: 141 - DNA, 16 bp, synthetic construct
  misc_feature 1..16: note = Synthetic oligonucleotide
  source 1..16: mol_type = other DNA
gccgtgcacacacaag

SEQ ID NO: 142 - DNA, 16 bp, synthetic construct
  misc_feature 1..16: note = Synthetic oligonucleotide
  source 1..16: mol_type = other DNA
ggatctgggaattatg

SEQ ID NO: 143 - DNA, 16 bp, synthetic construct
  misc_feature 1..16: note = Synthetic oligonucleotide
  source 1..16: mol_type = other DNA
aaagaactcaagtcag

SEQ ID NO: 144 - DNA, 16 bp, synthetic construct
  misc_feature 1..16: note = Synthetic oligonucleotide
  source 1..16: mol_type = other DNA
tgctccctgtaatcac

SEQ ID NO: 145 - DNA, 16 bp, synthetic construct
  misc_feature 1..16: note = Synthetic oligonucleotide
  source 1..16: mol_type = other DNA
gtgtttaggcattcag

SEQ ID NO: 146 - DNA, 16 bp, synthetic construct
  misc_feature 1..16: note = Synthetic oligonucleotide
  source 1..16: mol_type = other DNA
atgaaattattggttc

SEQ ID NO: 147 - DNA, 16 bp, synthetic construct
  misc_feature 1..16: note = Synthetic oligonucleotide
  source 1..16: mol_type = other DNA
tgcctgttgggtcaaa

SEQ ID NO: 148 - DNA, 16 bp, synthetic construct
  misc_feature 1..16: note = Synthetic oligonucleotide
  source 1..16: mol_type = other DNA
caccaacatgaagtga

SEQ ID NO: 149 - DNA, 16 bp, synthetic construct
  misc_feature 1..16: note = Synthetic oligonucleotide
  source 1..16: mol_type = other DNA
cccttttggcaccttc

SEQ ID NO: 150 - DNA, 16 bp, synthetic construct
  misc_feature 1..16: note = Synthetic oligonucleotide
  source 1..16: mol_type = other DNA
tctattagagggctag

SEQ ID NO: 151 - DNA, 16 bp, synthetic construct
  misc_feature 1..16: note = Synthetic oligonucleotide
  source 1..16: mol_type = other DNA
ctttaaactcaggtga

SEQ ID NO: 152 - DNA, 16 bp, synthetic construct
  misc_feature 1..16: note = Synthetic oligonucleotide
  source 1..16: mol_type = other DNA
ttatggagtcattagt

SEQ ID NO: 153 - DNA, 16 bp, synthetic construct
  misc_feature 1..16: note = Synthetic oligonucleotide
  source 1..16: mol_type = other DNA
tgcataacagccattg

SEQ ID NO: 154 - DNA, 16 bp, synthetic construct
  misc_feature 1..16: note = Synthetic oligonucleotide
  source 1..16: mol_type = other DNA
cccaagatataccgag

SEQ ID NO: 155 - DNA, 16 bp, synthetic construct
  misc_feature 1..16: note = Synthetic oligonucleotide
  source 1..16: mol_type = other DNA
gaatcttcccctggca

SEQ ID NO: 156 - DNA, 16 bp, synthetic construct
  misc_feature 1..16: note = Synthetic oligonucleotide
  source 1..16: mol_type = other DNA
caccctcgctccagct

SEQ ID NO: 157 - DNA, 16 bp, synthetic construct
  misc_feature 1..16: note = Synthetic oligonucleotide
  source 1..16: mol_type = other DNA
cagcccagtcaccgag

SEQ ID NO: 158 - DNA, 16 bp, synthetic construct
  misc_feature 1..16: note = Synthetic oligonucleotide
  source 1..16: mol_type = other DNA
tgtactgctggccttt

SEQ ID NO: 159 - DNA, 16 bp, synthetic construct
  misc_feature 1..16: note = Synthetic oligonucleotide
  source 1..16: mol_type = other DNA
cacggagccttcttat

SEQ ID NO: 160 - DNA, 16 bp, synthetic construct
  misc_feature 1..16: note = Synthetic oligonucleotide
  source 1..16: mol_type = other DNA
ggtggtgcctttgtgg

SEQ ID NO: 161 - DNA, 16 bp, synthetic construct
  misc_feature 1..16: note = Synthetic oligonucleotide
  source 1..16: mol_type = other DNA
gccagacccatgccga

SEQ ID NO: 162 - DNA, 16 bp, synthetic construct
  misc_feature 1..16: note = Synthetic oligonucleotide
  source 1..16: mol_type = other DNA
caaagcggctgtgatt

SEQ ID NO: 163 - DNA, 16 bp, synthetic construct
  misc_feature 1..16: note = Synthetic oligonucleotide
  source 1..16: mol_type = other DNA
cttctttccgtagtcc

SEQ ID NO: 164 - DNA, 16 bp, synthetic construct
  misc_feature 1..16: note = Synthetic oligonucleotide
  source 1..16: mol_type = other DNA
gttctcacccaaaaac

SEQ ID NO: 165 - DNA, 16 bp, synthetic construct
  misc_feature 1..16: note = Synthetic oligonucleotide
  source 1..16: mol_type = other DNA
gagggcacggatgtcc

SEQ ID NO: 166 - DNA, 16 bp, synthetic construct
  misc_feature 1..16: note = Synthetic oligonucleotide
  source 1..16: mol_type = other DNA
tgagattggctcagtg

SEQ ID NO: 167 - DNA, 16 bp, synthetic construct
  misc_feature 1..16: note = Synthetic oligonucleotide
  source 1..16: mol_type = other DNA
tgctgggttcattaac

SEQ ID NO: 168 - DNA, 16 bp, synthetic construct
  misc_feature 1..16: note = Synthetic oligonucleotide
  source 1..16: mol_type = other DNA
gtaagtgctttgattc

SEQ ID NO: 169 - DNA, 16 bp, synthetic construct
  misc_feature 1..16: note = Synthetic oligonucleotide
  source 1..16: mol_type = other DNA
cagttcttggtccgcc

SEQ ID NO: 170 - DNA, 16 bp, synthetic construct
  misc_feature 1..16: note = Synthetic oligonucleotide
  source 1..16: mol_type = other DNA
tcaccctctttatccc

SEQ ID NO: 171 - DNA, 16 bp, synthetic construct
  misc_feature 1..16: note = Synthetic oligonucleotide
  source 1..16: mol_type = other DNA
gctgtgctcagctatg

SEQ ID NO: 172 - DNA, 16 bp, synthetic construct
  misc_feature 1..16: note = Synthetic oligonucleotide
  source 1..16: mol_type = other DNA
tctttagtctaaagta

SEQ ID NO: 173 - DNA, 16 bp, synthetic construct
  misc_feature 1..16: note = Synthetic oligonucleotide
  source 1..16: mol_type = other DNA
taactcttgggctttc

SEQ ID NO: 174 - DNA, 16 bp, synthetic construct
  misc_feature 1..16: note = Synthetic oligonucleotide
  source 1..16: mol_type = other DNA
cttcattcttcggagg

SEQ ID NO: 175 - DNA, 16 bp, synthetic construct
  misc_feature 1..16: note = Synthetic oligonucleotide
  source 1..16: mol_type = other DNA
tcatcaggaagccgct

SEQ ID NO: 176 - DNA, 16 bp, synthetic construct
  misc_feature 1..16: note = Synthetic oligonucleotide
  source 1..16: mol_type = other DNA
ggccatggcccaccac

SEQ ID NO: 177 - DNA, 16 bp, synthetic construct
  misc_feature 1..16: note = Synthetic oligonucleotide
  source 1..16: mol_type = other DNA
agcttcctcccaatgc

SEQ ID NO: 178 - DNA, 16 bp, synthetic construct
  misc_feature 1..16: note = Synthetic oligonucleotide
  source 1..16: mol_type = other DNA
aggtcaatcctgggcg

SEQ ID NO: 179 - DNA, 16 bp, synthetic construct
  misc_feature 1..16: note = Synthetic oligonucleotide
  source 1..16: mol_type = other DNA
tctcatgattgcaaag

SEQ ID NO: 180 - DNA, 16 bp, synthetic construct
  misc_feature 1..16: note = Synthetic oligonucleotide
  source 1..16: mol_type = other DNA
gtctcagcagtcaaaa

SEQ ID NO: 181 - DNA, 16 bp, synthetic construct
  misc_feature 1..16: note = Synthetic oligonucleotide
  source 1..16: mol_type = other DNA
ttggttcctagaagaa

SEQ ID NO: 182 - DNA, 16 bp, synthetic construct
  misc_feature 1..16: note = Synthetic oligonucleotide
  source 1..16: mol_type = other DNA
actgagggtatatgaa

SEQ ID NO: 183 - DNA, 16 bp, synthetic construct
  misc_feature 1..16: note = Synthetic oligonucleotide
  source 1..16: mol_type = other DNA
gtgtgataactagctg

SEQ ID NO: 184 - DNA, 16 bp, synthetic construct
  misc_feature 1..16: note = Synthetic oligonucleotide
  source 1..16: mol_type = other DNA
ttttgttgcacccttg

SEQ ID NO: 185 - DNA, 16 bp, synthetic construct
  misc_feature 1..16: note = Synthetic oligonucleotide
  source 1..16: mol_type = other DNA
gtcatttgctaggtgc

SEQ ID NO: 186 - DNA, 16 bp, synthetic construct
  misc_feature 1..16: note = Synthetic oligonucleotide
  source 1..16: mol_type = other DNA
tggtcaacctcctctc

SEQ ID NO: 187 - DNA, 16 bp, synthetic construct
  misc_feature 1..16: note = Synthetic oligonucleotide
  source 1..16: mol_type = other DNA
atacattcccacaggg

SEQ ID NO: 188 - DNA, 16 bp, synthetic construct
  misc_feature 1..16: note = Synthetic oligonucleotide
  source 1..16: mol_type = other DNA
agggaggtaaggagcg

SEQ ID NO: 189 - DNA, 16 bp, synthetic construct
  misc_feature 1..16: note = Synthetic oligonucleotide
  source 1..16: mol_type = other DNA
aggccctattgtgtgg

SEQ ID NO: 190 - DNA, 16 bp, synthetic construct
  misc_feature 1..16: note = Synthetic oligonucleotide
  source 1..16: mol_type = other DNA
attgggcctcagattt

SEQ ID NO: 191 - DNA, 16 bp, synthetic construct
  misc_feature 1..16: note = Synthetic oligonucleotide
  source 1..16: mol_type = other DNA
gcacgaagcctcctcc

SEQ ID NO: 192 - DNA, 16 bp, synthetic construct
  misc_feature 1..16: note = Synthetic oligonucleotide
  source 1..16: mol_type = other DNA
attcacccgataaacc

SEQ ID NO: 193 - DNA, 16 bp, synthetic construct
  misc_feature 1..16: note = Synthetic oligonucleotide
  source 1..16: mol_type = other DNA
aacccaaacaggcagt

SEQ ID NO: 194 - DNA, 16 bp, synthetic construct
  misc_feature 1..16: note = Synthetic oligonucleotide
  source 1..16: mol_type = other DNA
tgtattcggagacctc

SEQ ID NO: 195 - DNA, 16 bp, synthetic construct
  misc_feature 1..16: note = Synthetic oligonucleotide
  source 1..16: mol_type = other DNA
aaacctgggcaaggct

SEQ ID NO: 196 - DNA, 16 bp, synthetic construct
  misc_feature 1..16: note = Synthetic oligonucleotide
  source 1..16: mol_type = other DNA
atgcttactccacacc

SEQ ID NO: 197 - DNA, 16 bp, synthetic construct
  misc_feature 1..16: note = Synthetic oligonucleotide
  source 1..16: mol_type = other DNA
cccatgtttggtacaa

SEQ ID NO: 198 - DNA, 16 bp, synthetic construct
  misc_feature 1..16: note = Synthetic oligonucleotide
  source 1..16: mol_type = other DNA
ccttgtctcactaaac

SEQ ID NO: 199 - DNA, 16 bp, synthetic construct
  misc_feature 1..16: note = Synthetic oligonucleotide
  source 1..16: mol_type = other DNA
ctaagaccagtgagat

SEQ ID NO: 200 - DNA, 16 bp, synthetic construct
  misc_feature 1..16: note = Synthetic oligonucleotide
  source 1..16: mol_type = other DNA
gaaaccacctgtaggg

SEQ ID NO: 201 - DNA, 16 bp, synthetic construct
  misc_feature 1..16: note = Synthetic oligonucleotide
  source 1..16: mol_type = other DNA
gatgggtacttctgtt

SEQ ID NO: 202 - DNA, 16 bp, synthetic construct
  misc_feature 1..16: note = Synthetic oligonucleotide
  source 1..16: mol_type = other DNA
ttagaacagctgtaac

SEQ ID NO: 203 - DNA, 16 bp, synthetic construct
  misc_feature 1..16: note = Synthetic oligonucleotide
  source 1..16: mol_type = other DNA
gggctggtggatataa

SEQ ID NO: 204 - DNA, 16 bp, synthetic construct
  misc_feature 1..16: note = Synthetic oligonucleotide
  source 1..16: mol_type = other DNA
cgagcgattgtcttgt

SEQ ID NO: 205 - DNA, 16 bp, synthetic construct
  misc_feature 1..16: note = Synthetic oligonucleotide
  source 1..16: mol_type = other DNA
gttgccgtggcaactc

SEQ ID NO: 206 - DNA, 16 bp, synthetic construct
  misc_feature 1..16: note = Synthetic oligonucleotide
  source 1..16: mol_type = other DNA
gagtttttcctcagtc

SEQ ID NO: 207 - DNA, 16 bp, synthetic construct
  misc_feature 1..16: note = Synthetic oligonucleotide
  source 1..16: mol_type = other DNA
gaggcacctccatgtt

SEQ ID NO: 208 - DNA, 16 bp, synthetic construct
  misc_feature 1..16: note = Synthetic oligonucleotide
  source 1..16: mol_type = other DNA
caaaggagattcctcc

SEQ ID NO: 209 - DNA, 16 bp, synthetic construct
  misc_feature 1..16: note = Synthetic oligonucleotide
  source 1..16: mol_type = other DNA
ctcccttatagcttac

SEQ ID NO: 210 - DNA, 16 bp, synthetic construct
  misc_feature 1..16: note = Synthetic oligonucleotide
  source 1..16: mol_type = other DNA
cgagagtcaccgccca

SEQ ID NO: 211 - DNA, 16 bp, synthetic construct
  misc_feature 1..16: note = Synthetic oligonucleotide
  source 1..16: mol_type = other DNA
ttcttgccgtgcacac

SEQ ID NO: 212 - DNA, 16 bp, synthetic construct
  misc_feature 1..16: note = Synthetic oligonucleotide
  source 1..16: mol_type = other DNA
cgtgtggtttgcaggg

SEQ ID NO: 213 - DNA, 16 bp, synthetic construct
  misc_feature 1..16: note = Synthetic oligonucleotide
  source 1..16: mol_type = other DNA
taggtctacaaagaac

SEQ ID NO: 214 - DNA, 16 bp, synthetic construct
  misc_feature 1..16: note = Synthetic oligonucleotide
  source 1..16: mol_type = other DNA
tggactgctccctgta

SEQ ID NO: 215 - DNA, 16 bp, synthetic construct
  misc_feature 1..16: note = Synthetic oligonucleotide
  source 1..16: mol_type = other DNA
agatgtgtttaggcat

SEQ ID NO: 216 - DNA, 16 bp, synthetic construct
  misc_feature 1..16: note = Synthetic oligonucleotide
  source 1..16: mol_type = other DNA
catcattgggttatga

SEQ ID NO: 217 - DNA, 16 bp, synthetic construct
  misc_feature 1..16: note = Synthetic oligonucleotide
  source 1..16: mol_type = other DNA
cacatgcctgttgggt

SEQ ID NO: 218 - DNA, 16 bp, synthetic construct
  misc_feature 1..16: note = Synthetic oligonucleotide
  source 1..16: mol_type = other DNA
ttttcagctcagcacc

SEQ ID NO: 219 - DNA, 16 bp, synthetic construct
  misc_feature 1..16: note = Synthetic oligonucleotide
  source 1..16: mol_type = other DNA
agactccaaccctttt

SEQ ID NO: 220 - DNA, 16 bp, synthetic construct
  misc_feature 1..16: note = Synthetic oligonucleotide
  source 1..16: mol_type = other DNA
taattctattagaggg

SEQ ID NO: 221 - DNA, 16 bp, synthetic construct
  misc_feature 1..16: note = Synthetic oligonucleotide
  source 1..16: mol_type = other DNA
tgaagctttaaactca

SEQ ID NO: 222 - DNA, 16 bp, synthetic construct
  misc_feature 1..16: note = Synthetic oligonucleotide
  source 1..16: mol_type = other DNA
gacttgttttatggag

SEQ ID NO: 223 - DNA, 16 bp, synthetic construct
  misc_feature 1..16: note = Synthetic oligonucleotide
  source 1..16: mol_type = other DNA
ggagtgcataacagcc

SEQ ID NO: 224 - DNA, 16 bp, synthetic construct
  misc_feature 1..16: note = Synthetic oligonucleotide
  source 1..16: mol_type = other DNA
ccccaagatataccga

SEQ ID NO: 225 - DNA, 16 bp, synthetic construct
  misc_feature 1..16: note = Synthetic oligonucleotide
  source 1..16: mol_type = other DNA
ggaatcttcccctggc

SEQ ID NO: 226 - DNA, 16 bp, synthetic construct
  misc_feature 1..16: note = Synthetic oligonucleotide
  source 1..16: mol_type = other DNA
gcaccctcgctccagc

SEQ ID NO: 227 - DNA, 16 bp, synthetic construct
  misc_feature 1..16: note = Synthetic oligonucleotide
  source 1..16: mol_type = other DNA
gcagcccagtcaccga

SEQ ID NO: 228 - DNA, 16 bp, synthetic construct
  misc_feature 1..16: note = Synthetic oligonucleotide
  source 1..16: mol_type = other DNA
ctgtactgctggcctt

SEQ ID NO: 229 - DNA, 16 bp, synthetic construct
  misc_feature 1..16: note = Synthetic oligonucleotide
  source 1..16: mol_type = other DNA
gcacggagccttctta

SEQ ID NO: 230 - DNA, 16 bp, synthetic construct
  misc_feature 1..16: note = Synthetic oligonucleotide
  source 1..16: mol_type = other DNA
tggtggtgcctttgtg

SEQ ID NO: 231 - DNA, 16 bp, synthetic construct
  misc_feature 1..16: note = Synthetic oligonucleotide
  source 1..16: mol_type = other DNA
tgccagacccatgccg

SEQ ID NO: 232 - DNA, 16 bp, synthetic construct
  misc_feature 1..16: note = Synthetic oligonucleotide
  source 1..16: mol_type = other DNA
cggtcaaagcggctgt

SEQ ID NO: 233 - DNA, 16 bp, synthetic construct
  misc_feature 1..16: note = Synthetic oligonucleotide
  source 1..16: mol_type = other DNA
acttctttccgtagtc

SEQ ID NO: 234 - DNA, 16 bp, synthetic construct
  misc_feature 1..16: note = Synthetic oligonucleotide
  source 1..16: mol_type = other DNA
atatgttctcacccaa

SEQ ID NO: 235 - DNA, 16 bp, synthetic construct
  misc_feature 1..16: note = Synthetic oligonucleotide
  source 1..16: mol_type = other DNA
tgagggcacggatgtc

SEQ ID NO: 236 - DNA, 16 bp, synthetic construct
  misc_feature 1..16: note = Synthetic oligonucleotide
  source 1..16: mol_type = other DNA
cagctgagattggctc

SEQ ID NO: 237 - DNA, 16 bp, synthetic construct
  misc_feature 1..16: note = Synthetic oligonucleotide
  source 1..16: mol_type = other DNA
atgctgggttcattaa

SEQ ID NO: 238 - DNA, 16 bp, synthetic construct
  misc_feature 1..16: note = Synthetic oligonucleotide
  source 1..16: mol_type = other DNA
atgtaagtgctttgat

SEQ ID NO: 239 - DNA, 16 bp, synthetic construct
  misc_feature 1..16: note = Synthetic oligonucleotide
  source 1..16: mol_type = other DNA
acagttcttggtccgc

SEQ ID NO: 240 - DNA, 16 bp, synthetic construct
  misc_feature 1..16: note = Synthetic oligonucleotide
  source 1..16: mol_type = other DNA
ctcaccctctttatcc

SEQ ID NO: 241 - DNA, 16 bp, synthetic construct
  misc_feature 1..16: note = Synthetic oligonucleotide
  source 1..16: mol_type = other DNA
ctgccatctgcattaa

SEQ ID NO: 242 - DNA, 16 bp, synthetic construct
  misc_feature 1..16: note = Synthetic oligonucleotide
  source 1..16: mol_type = other DNA
ccccccaatatattct

SEQ ID NO: 243 - DNA, 16 bp, synthetic construct
  misc_feature 1..16: note = Synthetic oligonucleotide
  source 1..16: mol_type = other DNA
gttctaactcttgggc

SEQ ID NO: 244 - DNA, 16 bp, synthetic construct
  misc_feature 1..16: note = Synthetic oligonucleotide
  source 1..16: mol_type = other DNA
acttcattcttcggag

SEQ ID NO: 245 - DNA, 16 bp, synthetic construct
  misc_feature 1..16: note = Synthetic oligonucleotide
  source 1..16: mol_type = other DNA
atcatcaggaagccgc

SEQ ID NO: 246 - DNA, 16 bp, synthetic construct
  misc_feature 1..16: note = Synthetic oligonucleotide
  source 1..16: mol_type = other DNA
tggccatggcccacca

SEQ ID NO: 247 - DNA, 16 bp, synthetic construct
  misc_feature 1..16: note = Synthetic oligonucleotide
  source 1..16: mol_type = other DNA
gagcttcctcccaatg

SEQ ID NO: 248 - DNA, 16 bp, synthetic construct
  misc_feature 1..16: note = Synthetic oligonucleotide
  source 1..16: mol_type = other DNA
atgagtaggtgagttt

SEQ ID NO: 249 - DNA, 16 bp, synthetic construct
  misc_feature 1..16: note = Synthetic oligonucleotide
  source 1..16: mol_type = other DNA
aatctcatgattgcaa

SEQ ID NO: 250 - DNA, 16 bp, synthetic construct
  misc_feature 1..16: note = Synthetic oligonucleotide
  source 1..16: mol_type = other DNA
tgtctcagcagtcaaa

SEQ ID NO: 251 - DNA, 16 bp, synthetic construct
  misc_feature 1..16: note = Synthetic oligonucleotide
  source 1..16: mol_type = other DNA
tttggttcctagaaga

SEQ ID NO: 252 - DNA, 16 bp, synthetic construct
  misc_feature 1..16: note = Synthetic oligonucleotide
  source 1..16: mol_type = other DNA
acaactgagggtatat

SEQ ID NO: 253 - DNA, 16 bp, synthetic construct
  misc_feature 1..16: note = Synthetic oligonucleotide
  source 1..16: mol_type = other DNA
agcatgtgtgataact

SEQ ID NO: 254 - DNA, 16 bp, synthetic construct
  misc_feature 1..16: note = Synthetic oligonucleotide
  source 1..16: mol_type = other DNA
tacctgggtccatggt

SEQ ID NO: 255 - DNA, 16 bp, synthetic construct
  misc_feature 1..16: note = Synthetic oligonucleotide
  source 1..16: mol_type = other DNA
gagtcatttgctaggt

SEQ ID NO: 256 - DNA, 16 bp, synthetic construct
  misc_feature 1..16: note = Synthetic oligonucleotide
  source 1..16: mol_type = other DNA
gctggtcaacctcctc

SEQ ID NO: 257 - DNA, 16 bp, synthetic construct
  misc_feature 1..16: note = Synthetic oligonucleotide
  source 1..16: mol_type = other DNA
gatacattcccacagg

SEQ ID NO: 258 - DNA, 16 bp, synthetic construct
  misc_feature 1..16: note = Synthetic oligonucleotide
  source 1..16: mol_type = other DNA
aagggaggtaaggagc

SEQ ID NO: 259 - DNA, 16 bp, synthetic construct
  misc_feature 1..16: note = Synthetic oligonucleotide
  source 1..16: mol_type = other DNA
gaggccctattgtgtg

SEQ ID NO: 260 - DNA, 16 bp, synthetic construct
  misc_feature 1..16: note = Synthetic oligonucleotide
  source 1..16: mol_type = other DNA
tattgggcctcagatt

SEQ ID NO: 261 - DNA, 16 bp, synthetic construct
  misc_feature 1..16: note = Synthetic oligonucleotide
  source 1..16: mol_type = other DNA
agcacgaagcctcctc

SEQ ID NO: 262 - DNA, 16 bp, synthetic construct
  misc_feature 1..16: note = Synthetic oligonucleotide
  source 1..16: mol_type = other DNA
tcatattcacccgata

SEQ ID NO: 263 - DNA, 16 bp, synthetic construct
  misc_feature 1..16: note = Synthetic oligonucleotide
  source 1..16: mol_type = other DNA
taaacccaaacaggca

SEQ ID NO: 264 - DNA, 16 bp, synthetic construct
  misc_feature 1..16: note = Synthetic oligonucleotide
  source 1..16: mol_type = other DNA
ctgtattcggagacct

SEQ ID NO: 265 - DNA, 16 bp, synthetic construct
  misc_feature 1..16: note = Synthetic oligonucleotide
  source 1..16: mol_type = other DNA
caaaaacctgggcaag

SEQ ID NO: 266 - DNA, 16 bp, synthetic construct
  misc_feature 1..16: note = Synthetic oligonucleotide
  source 1..16: mol_type = other DNA
tatgcttactccacac

SEQ ID NO: 267 - DNA, 16 bp, synthetic construct
  misc_feature 1..16: note = Synthetic oligonucleotide
  source 1..16: mol_type = other DNA
tgcccatgtttggtac

SEQ ID NO: 268 - DNA, 16 bp, synthetic construct
  misc_feature 1..16: note = Synthetic oligonucleotide
  source 1..16: mol_type = other DNA
ctccttgtctcactaa

SEQ ID NO: 269 - DNA, 16 bp, synthetic construct
  misc_feature 1..16: note = Synthetic oligonucleotide
  source 1..16: mol_type = other DNA
gctaagaccagtgaga

SEQ ID NO: 270 - DNA, 16 bp, synthetic construct
  misc_feature 1..16: note = Synthetic oligonucleotide
  source 1..16: mol_type = other DNA
tgaaaccacctgtagg

SEQ ID NO: 271 - DNA, 16 bp, synthetic construct
  misc_feature 1..16: note = Synthetic oligonucleotide
  source 1..16: mol_type = other DNA
agatgggtacttctgt

SEQ ID NO: 272 - DNA, 16 bp, synthetic construct
  misc_feature 1..16: note = Synthetic oligonucleotide
  source 1..16: mol_type = other DNA
ctttagaacagctgta

SEQ ID NO: 273 - DNA, 16 bp, synthetic construct
  misc_feature 1..16: note = Synthetic oligonucleotide
  source 1..16: mol_type = other DNA
ttcttgatgtggtggg

SEQ ID NO: 274 - DNA, 16 bp, synthetic construct
  misc_feature 1..16: note = Synthetic oligonucleotide
  source 1..16: mol_type = other DNA
gcgagcgattgtcttg

SEQ ID NO: 275 - DNA, 16 bp, synthetic construct
  misc_feature 1..16: note = Synthetic oligonucleotide
  source 1..16: mol_type = other DNA
ggttgccgtggcaact

SEQ ID NO: 276 - DNA, 16 bp, synthetic construct
  misc_feature 1..16: note = Synthetic oligonucleotide
  source 1..16: mol_type = other DNA
gggagagtttttcctc

SEQ ID NO: 277 - DNA, 16 bp, synthetic construct
  misc_feature 1..16: note = Synthetic oligonucleotide
  source 1..16: mol_type = other DNA
tgaggcacctccatgt

SEQ ID NO: 278 - DNA, 16 bp, synthetic construct
  misc_feature 1..16: note = Synthetic oligonucleotide
  source 1..16: mol_type = other DNA
gcaaaggagattcctc

SEQ ID NO: 279 - DNA, 16 bp, synthetic construct
  misc_feature 1..16: note = Synthetic oligonucleotide
  source 1..16: mol_type = other DNA
tctcccttatagctta

SEQ ID NO: 280 - DNA, 16 bp, synthetic construct
  misc_feature 1..16: note = Synthetic oligonucleotide
  source 1..16: mol_type = other DNA
gcgagagtcaccgccc

SEQ ID NO: 281 - DNA, 16 bp, synthetic construct
  misc_feature 1..16: note = Synthetic oligonucleotide
  source 1..16: mol_type = other DNA
tttcttgccgtgcaca

SEQ ID NO: 282 - DNA, 16 bp, synthetic construct
  misc_feature 1..16: note = Synthetic oligonucleotide
  source 1..16: mol_type = other DNA
agctgccaccaaaacg

SEQ ID NO: 283 - DNA, 16 bp, synthetic construct
  misc_feature 1..16: note = Synthetic oligonucleotide
  source 1..16: mol_type = other DNA
gtaggtctacaaagaa

SEQ ID NO: 284 - DNA, 16 bp, synthetic construct
  misc_feature 1..16: note = Synthetic oligonucleotide
  source 1..16: mol_type = other DNA
ctggactgctccctgt

SEQ ID NO: 285 - DNA, 16 bp, synthetic construct
  misc_feature 1..16: note = Synthetic oligonucleotide
  source 1..16: mol_type = other DNA
cagatgtgtttaggca

SEQ ID NO: 286 - DNA, 16 bp, synthetic construct
  misc_feature 1..16: note = Synthetic oligonucleotide
  source 1..16: mol_type = other DNA
acatcattgggttatg

SEQ ID NO: 287 - DNA, 16 bp, synthetic construct
  misc_feature 1..16: note = Synthetic oligonucleotide
  source 1..16: mol_type = other DNA
ccacatgcctgttggg

SEQ ID NO: 288 - DNA, 16 bp, synthetic construct
  misc_feature 1..16: note = Synthetic oligonucleotide
  source 1..16: mol_type = other DNA
gaatccttttcagctc

SEQ ID NO: 289 - DNA, 16 bp, synthetic construct
  misc_feature 1..16: note = Synthetic oligonucleotide
  source 1..16: mol_type = other DNA
cagactccaacccttt

SEQ ID NO: 290 - DNA, 16 bp, synthetic construct
  misc_feature 1..16: note = Synthetic oligonucleotide
  source 1..16: mol_type = other DNA
ctaattctattagagg

SEQ ID NO: 291 - DNA, 16 bp, synthetic construct
  misc_feature 1..16: note = Synthetic oligonucleotide
  source 1..16: mol_type = other DNA
gctgaagctttaaact

SEQ ID NO: 292 - DNA, 16 bp, synthetic construct
  misc_feature 1..16: note = Synthetic oligonucleotide
  source 1..16: mol_type = other DNA
gtgggacttgttttat

SEQ ID NO: 293 - DNA, 16 bp, synthetic construct
  misc_feature 1..16: note = Synthetic oligonucleotide
  source 1..16: mol_type = other DNA
gggagtgcataacagc

SEQ ID NO: 294 - DNA, 16 bp, synthetic construct
  misc_feature 1..16: note = Synthetic oligonucleotide
  source 1..16: mol_type = other DNA
tccccaagatataccg

SEQ ID NO: 295 - DNA, 16 bp, synthetic construct
  misc_feature 1..16: note = Synthetic oligonucleotide
  source 1..16: mol_type = other DNA
aggaatcttcccctgg

SEQ ID NO: 296 - DNA, 16 bp, synthetic construct
  misc_feature 1..16: note = Synthetic oligonucleotide
  source 1..16: mol_type = other DNA
tgcaccctcgctccag

SEQ ID NO: 297 - DNA, 16 bp, synthetic construct
  misc_feature 1..16: note = Synthetic oligonucleotide
  source 1..16: mol_type = other DNA
agcagcccagtcaccg

SEQ ID NO: 298 - DNA, 16 bp, synthetic construct
  misc_feature 1..16: note = Synthetic oligonucleotide
  source 1..16: mol_type = other DNA
tctgtactgctggcct

SEQ ID NO: 299 - DNA, 16 bp, synthetic construct
  misc_feature 1..16: note = Synthetic oligonucleotide
  source 1..16: mol_type = other DNA
ggcacggagccttctt

SEQ ID NO: 300 - DNA, 16 bp, synthetic construct
  misc_feature 1..16: note = Synthetic oligonucleotide
  source 1..16: mol_type = other DNA
atggtggtgcctttgt

SEQ ID NO: 301 - DNA, 16 bp, synthetic construct
  misc_feature 1..16: note = Synthetic oligonucleotide
  source 1..16: mol_type = other DNA
gtgccagacccatgcc

SEQ ID NO: 302 - DNA, 16 bp, synthetic construct
  misc_feature 1..16: note = Synthetic oligonucleotide
  source 1..16: mol_type = other DNA
ccggtcaaagcggctg

SEQ ID NO: 303 - DNA, 16 bp, synthetic construct
  misc_feature 1..16: note = Synthetic oligonucleotide
  source 1..16: mol_type = other DNA
cacttctttccgtagt

SEQ ID NO: 304 - DNA, 16 bp, synthetic construct
  misc_feature 1..16: note = Synthetic oligonucleotide
  source 1..16: mol_type = other DNA
gatatgttctcaccca

SEQ ID NO: 305 - DNA, 16 bp, synthetic construct
  misc_feature 1..16: note = Synthetic oligonucleotide
  source 1..16: mol_type = other DNA
ctgagggcacggatgt

SEQ ID NO: 306 - DNA, 16 bp, synthetic construct
  misc_feature 1..16: note = Synthetic oligonucleotide
  source 1..16: mol_type = other DNA
tcagctgagattggct

SEQ ID NO: 307 - DNA, 16 bp, synthetic construct
  misc_feature 1..16: note = Synthetic oligonucleotide
  source 1..16: mol_type = other DNA
gatgctgggttcatta

SEQ ID NO: 308 - DNA, 16 bp, synthetic construct
  misc_feature 1..16: note = Synthetic oligonucleotide
  source 1..16: mol_type = other DNA
tcatgtaagtgctttg

SEQ ID NO: 309 - DNA, 16 bp, synthetic construct
  misc_feature 1..16: note = Synthetic oligonucleotide
  source 1..16: mol_type = other DNA
cacagttcttggtccg

SEQ ID NO: 310 - DNA, 16 bp, synthetic construct
  misc_feature 1..16: note = Synthetic oligonucleotide
  source 1..16: mol_type = other DNA
tacctcaccctcttta

SEQ ID NO: 311 - DNA, 16 bp, synthetic construct
  misc_feature 1..16: note = Synthetic oligonucleotide
  source 1..16: mol_type = other DNA
actgccatctgcatta

SEQ ID NO: 312 - DNA, 16 bp, synthetic construct
  misc_feature 1..16: note = Synthetic oligonucleotide
  source 1..16: mol_type = other DNA
gccccccaatatattc

SEQ ID NO: 313 - DNA, 16 bp, synthetic construct
  misc_feature 1..16: note = Synthetic oligonucleotide
  source 1..16: mol_type = other DNA
tgttctaactcttggg

SEQ ID NO: 314 - DNA, 16 bp, synthetic construct
  misc_feature 1..16: note = Synthetic oligonucleotide
  source 1..16: mol_type = other DNA
gacttcattcttcgga

SEQ ID NO: 315 - DNA, 16 bp, synthetic construct
  misc_feature 1..16: note = Synthetic oligonucleotide
  source 1..16: mol_type = other DNA
catcatcaggaagccg

SEQ ID NO: 316 - DNA, 16 bp, synthetic construct
  misc_feature 1..16: note = Synthetic oligonucleotide
  source 1..16: mol_type = other DNA
atggccatggcccacc

SEQ ID NO: 317 - DNA, 16 bp, synthetic construct
  misc_feature 1..16: note = Synthetic oligonucleotide
  source 1..16: mol_type = other DNA
tgagcttcctcccaat

SEQ ID NO: 318 - DNA, 16 bp, synthetic construct
  misc_feature 1..16: note = Synthetic oligonucleotide
  source 1..16: mol_type = other DNA
gatgagtaggtgagtt

SEQ ID NO: 319 - DNA, 16 bp, synthetic construct
  misc_feature 1..16: note = Synthetic oligonucleotide
  source 1..16: mol_type = other DNA
gaatctcatgattgca

SEQ ID NO: 320 - DNA, 16 bp, synthetic construct
  misc_feature 1..16: note = Synthetic oligonucleotide
  source 1..16: mol_type = other DNA
agatgggcacccccaa

SEQ ID NO: 321 - DNA, 16 bp, synthetic construct
  misc_feature 1..16: note = Synthetic oligonucleotide
  source 1..16: mol_type = other DNA
ttccgggaagtgactt

SEQ ID NO: 322 - DNA, 16 bp, synthetic construct
  misc_feature 1..16: note = Synthetic oligonucleotide
  source 1..16: mol_type = other DNA
aacaccaattagtaca

SEQ ID NO: 323 - DNA, 16 bp, synthetic construct
  misc_feature 1..16: note = Synthetic oligonucleotide
  source 1..16: mol_type = other DNA
caatgaccagggcctg

SEQ ID NO: 324 - DNA, 16 bp, synthetic construct
  misc_feature 1..16: note = Synthetic oligonucleotide
  source 1..16: mol_type = other DNA
agcctacctgggtcca

SEQ ID NO: 325 - DNA, 16 bp, synthetic construct
  misc_feature 1..16: note = Synthetic oligonucleotide
  source 1..16: mol_type = other DNA
tgagtcatttgctagg

SEQ ID NO: 326 - DNA, 16 bp, synthetic construct
  misc_feature 1..16: note = Synthetic oligonucleotide
  source 1..16: mol_type = other DNA
gaggtgacaggtcggg

SEQ ID NO: 327 - DNA, 16 bp, synthetic construct
  misc_feature 1..16: note = Synthetic oligonucleotide
  source 1..16: mol_type = other DNA
cgatacattcccacag

SEQ ID NO: 328 - DNA, 16 bp, synthetic construct
  misc_feature 1..16: note = Synthetic oligonucleotide
  source 1..16: mol_type = other DNA
atggtacaggagaagg

SEQ ID NO: 329 - DNA, 16 bp, synthetic construct
  misc_feature 1..16: note = Synthetic oligonucleotide
  source 1..16: mol_type = other DNA
ggaggccctattgtgt

SEQ ID NO: 330 - DNA, 16 bp, synthetic construct
  misc_feature 1..16: note = Synthetic oligonucleotide
  source 1..16: mol_type = other DNA
ctattgggcctcagat

SEQ ID NO: 331 - DNA, 16 bp, synthetic construct
  misc_feature 1..16: note = Synthetic oligonucleotide
  source 1..16: mol_type = other DNA
atagcacgaagcctcc

SEQ ID NO: 332 - DNA, 16 bp, synthetic construct
  misc_feature 1..16: note = Synthetic oligonucleotide
  source 1..16: mol_type = other DNA
ttcatattcacccgat

SEQ ID NO: 333 - DNA, 16 bp, synthetic construct
  misc_feature 1..16: note = Synthetic oligonucleotide
  source 1..16: mol_type = other DNA
gtaaacccaaacaggc

SEQ ID NO: 334 - DNA, 16 bp, synthetic construct
  misc_feature 1..16: note = Synthetic oligonucleotide
  source 1..16: mol_type = other DNA
cctgtattcggagacc

SEQ ID NO: 335 - DNA, 16 bp, synthetic construct
  misc_feature 1..16: note = Synthetic oligonucleotide
  source 1..16: mol_type = other DNA
atcaaaaacctgggca

SEQ ID NO: 336 - DNA, 16 bp, synthetic construct
  misc_feature 1..16: note = Synthetic oligonucleotide
  source 1..16: mol_type = other DNA
ttatgcttactccaca

SEQ ID NO: 337 - DNA, 16 bp, synthetic construct
  misc_feature 1..16: note = Synthetic oligonucleotide
  source 1..16: mol_type = other DNA
atgcccatgtttggta

SEQ ID NO: 338 - DNA, 16 bp, synthetic construct
  misc_feature 1..16: note = Synthetic oligonucleotide
  source 1..16: mol_type = other DNA
cctccttgtctcacta

SEQ ID NO: 339 - DNA, 16 bp, synthetic construct
  misc_feature 1..16: note = Synthetic oligonucleotide
  source 1..16: mol_type = other DNA
agctaagaccagtgag

SEQ ID NO: 340 - DNA, 16 bp, synthetic construct
  misc_feature 1..16: note = Synthetic oligonucleotide
  source 1..16: mol_type = other DNA
ctgaaaccacctgtag

SEQ ID NO: 341 - DNA, 16 bp, synthetic construct
  misc_feature 1..16: note = Synthetic oligonucleotide
  source 1..16: mol_type = other DNA
cagatgggtacttctg

SEQ ID NO: 342 - DNA, 16 bp, synthetic construct
  misc_feature 1..16: note = Synthetic oligonucleotide
  source 1..16: mol_type = other DNA
gcctttagaacagctg

SEQ ID NO: 343 - DNA, 16 bp, synthetic construct
  misc_feature 1..16: note = Synthetic oligonucleotide
  source 1..16: mol_type = other DNA
atttcttgatgtggtg

SEQ ID NO: 344 - DNA, 16 bp, synthetic construct
  misc_feature 1..16: note = Synthetic oligonucleotide
  source 1..16: mol_type = other DNA
ggcgagcgattgtctt

SEQ ID NO: 345 - DNA, 16 bp, synthetic construct
  misc_feature 1..16: note = Synthetic oligonucleotide
  source 1..16: mol_type = other DNA
tggttgccgtggcaac

SEQ ID NO: 346 - DNA, 16 bp, synthetic construct
  misc_feature 1..16: note = Synthetic oligonucleotide
  source 1..16: mol_type = other DNA
atcatcttgttttggg

SEQ ID NO: 347 - DNA, 16 bp, synthetic construct
  misc_feature 1..16: note = Synthetic oligonucleotide
  source 1..16: mol_type = other DNA
ttgaggcacctccatg

SEQ ID NO: 348 - DNA, 16 bp, synthetic construct
  misc_feature 1..16: note = Synthetic oligonucleotide
  source 1..16: mol_type = other DNA
atgcaaaggagattcc

SEQ ID NO: 349 - DNA, 16 bp, synthetic construct
  misc_feature 1..16: note = Synthetic oligonucleotide
  source 1..16: mol_type = other DNA
ttctcccttatagctt

SEQ ID NO: 350 - DNA, 16 bp, synthetic construct
  misc_feature 1..16: note = Synthetic oligonucleotide
  source 1..16: mol_type = other DNA
agcgagagtcaccgcc

SEQ ID NO: 351 - DNA, 16 bp, synthetic construct
  misc_feature 1..16: note = Synthetic oligonucleotide
  source 1..16: mol_type = other DNA
gtttcttgccgtgcac

SEQ ID NO: 352 - DNA, 16 bp, synthetic construct
  misc_feature 1..16: note = Synthetic oligonucleotide
  source 1..16: mol_type = other DNA
gtcagctgccaccaaa

SEQ ID NO: 353 - DNA, 16 bp, synthetic construct
  misc_feature 1..16: note = Synthetic oligonucleotide
  source 1..16: mol_type = other DNA
ggtaggtctacaaaga

SEQ ID NO: 354 - DNA, 16 bp, synthetic construct
  misc_feature 1..16: note = Synthetic oligonucleotide
  source 1..16: mol_type = other DNA
gaggctggactgctcc

SEQ ID NO: 355 - DNA, 16 bp, synthetic construct
  misc_feature 1..16: note = Synthetic oligonucleotide
  source 1..16: mol_type = other DNA
ccagatgtgtttaggc

SEQ ID NO: 356 - DNA, 16 bp, synthetic construct
  misc_feature 1..16: note = Synthetic oligonucleotide
  source 1..16: mol_type = other DNA
cacatcattgggttat

SEQ ID NO: 357 - DNA, 16 bp, synthetic construct
  misc_feature 1..16: note = Synthetic oligonucleotide
  source 1..16: mol_type = other DNA
gccacatgcctgttgg

SEQ ID NO: 358 - DNA, 16 bp, synthetic construct
  misc_feature 1..16: note = Synthetic oligonucleotide
  source 1..16: mol_type = other DNA
gagaggaatgaatcct

SEQ ID NO: 359 - DNA, 16 bp, synthetic construct
  misc_feature 1..16: note = Synthetic oligonucleotide
  source 1..16: mol_type = other DNA
gagtcctccccagact

SEQ ID NO: 360 - DNA, 16 bp, synthetic construct
  misc_feature 1..16: note = Synthetic oligonucleotide
  source 1..16: mol_type = other DNA
gctctaattctattag

SEQ ID NO: 361 - DNA, 16 bp, synthetic construct
  misc_feature 1..16: note = Synthetic oligonucleotide
  source 1..16: mol_type = other DNA
tgctgaagctttaaac

SEQ ID NO: 362 - DNA, 16 bp, synthetic construct
  misc_feature 1..16: note = Synthetic oligonucleotide
  source 1..16: mol_type = other DNA
tgtgggacttgtttta

SEQ ID NO: 363 - DNA, 16 bp, synthetic construct
  misc_feature 1..16: note = Synthetic oligonucleotide
  source 1..16: mol_type = other DNA
gtgggagtgcataaca

SEQ ID NO: 364 - DNA, 16 bp, synthetic construct
  misc_feature 1..16: note = Synthetic oligonucleotide
  source 1..16: mol_type = other DNA
gtccccaagatatacc

SEQ ID NO: 365 - DNA, 16 bp, synthetic construct
  misc_feature 1..16: note = Synthetic oligonucleotide
  source 1..16: mol_type = other DNA
ccaaggaatcttcccc

SEQ ID NO: 366 - DNA, 16 bp, synthetic construct
  misc_feature 1..16: note = Synthetic oligonucleotide
  source 1..16: mol_type = other DNA
ttgcaccctcgctcca

SEQ ID NO: 367 - DNA, 16 bp, synthetic construct
  misc_feature 1..16: note = Synthetic oligonucleotide
  source 1..16: mol_type = other DNA
gtgccagcagcccagt

SEQ ID NO: 368 - DNA, 16 bp, synthetic construct
  misc_feature 1..16: note = Synthetic oligonucleotide
  source 1..16: mol_type = other DNA
ttctgtactgctggcc

SEQ ID NO: 369 - DNA, 16 bp, synthetic construct
  misc_feature 1..16: note = Synthetic oligonucleotide
  source 1..16: mol_type = other DNA
gggcacggagccttct

SEQ ID NO: 370 - DNA, 16 bp, synthetic construct
  misc_feature 1..16: note = Synthetic oligonucleotide
  source 1..16: mol_type = other DNA
gatggtggtgcctttg

SEQ ID NO: 371 - DNA, 16 bp, synthetic construct
  misc_feature 1..16: note = Synthetic oligonucleotide
  source 1..16: mol_type = other DNA
ggtgccagacccatgc

SEQ ID NO: 372 - DNA, 16 bp, synthetic construct
  misc_feature 1..16: note = Synthetic oligonucleotide
  source 1..16: mol_type = other DNA
cccggtcaaagcggct

SEQ ID NO: 373 - DNA, 16 bp, synthetic construct
  misc_feature 1..16: note = Synthetic oligonucleotide
  source 1..16: mol_type = other DNA
ccacttctttccgtag

SEQ ID NO: 374 - DNA, 16 bp, synthetic construct
  misc_feature 1..16: note = Synthetic oligonucleotide
  source 1..16: mol_type = other DNA
agttggatatgttctc

SEQ ID NO: 375 - DNA, 16 bp, synthetic construct
  misc_feature 1..16: note = Synthetic oligonucleotide
  source 1..16: mol_type = other DNA
tctgagggcacggatg

SEQ ID NO: 376 - DNA, 16 bp, synthetic construct
  misc_feature 1..16: note = Synthetic oligonucleotide
  source 1..16: mol_type = other DNA
ttcagctgagattggc

SEQ ID NO: 377 - DNA, 16 bp, synthetic construct
  misc_feature 1..16: note = Synthetic oligonucleotide
  source 1..16: mol_type = other DNA
ggatgctgggttcatt

SEQ ID NO: 378 - DNA, 16 bp, synthetic construct
  misc_feature 1..16: note = Synthetic oligonucleotide
  source 1..16: mol_type = other DNA
ctcatgtaagtgcttt

SEQ ID NO: 379 - DNA, 16 bp, synthetic construct
  misc_feature 1..16: note = Synthetic oligonucleotide
  source 1..16: mol_type = other DNA
gtcacagttcttggtc

SEQ ID NO: 380 - DNA, 16 bp, synthetic construct
  misc_feature 1..16: note = Synthetic oligonucleotide
  source 1..16: mol_type = other DNA
ttacctcaccctcttt

SEQ ID NO: 381 - DNA, 16 bp, synthetic construct
  misc_feature 1..16: note = Synthetic oligonucleotide
  source 1..16: mol_type = other DNA
cactgccatctgcatt

SEQ ID NO: 382 - DNA, 16 bp, synthetic construct
  misc_feature 1..16: note = Synthetic oligonucleotide
  source 1..16: mol_type = other DNA
ggccccccaatatatt

SEQ ID NO: 383 - DNA, 16 bp, synthetic construct
  misc_feature 1..16: note = Synthetic oligonucleotide
  source 1..16: mol_type = other DNA
ctgttctaactcttgg

SEQ ID NO: 384 - DNA, 16 bp, synthetic construct
  misc_feature 1..16: note = Synthetic oligonucleotide
  source 1..16: mol_type = other DNA
agacttcattcttcgg

SEQ ID NO: 385 - DNA, 16 bp, synthetic construct
  misc_feature 1..16: note = Synthetic oligonucleotide
  source 1..16: mol_type = other DNA
ccatcatcaggaagcc

SEQ ID NO: 386 - DNA, 16 bp, synthetic construct
  misc_feature 1..16: note = Synthetic oligonucleotide
  source 1..16: mol_type = other DNA
ggaccatggccatggc

SEQ ID NO: 387 - DNA, 16 bp, synthetic construct
  misc_feature 1..16: note = Synthetic oligonucleotide
  source 1..16: mol_type = other DNA
gatctgagcttcctcc

SEQ ID NO: 388 - DNA, 16 bp, synthetic construct
  misc_feature 1..16: note = Synthetic oligonucleotide
  source 1..16: mol_type = other DNA
tgatgagtaggtgagt

SEQ ID NO: 389 - DNA, 16 bp, synthetic construct
  misc_feature 1..16: note = Synthetic oligonucleotide
  source 1..16: mol_type = other DNA
tgaatctcatgattgc

SEQ ID NO: 390 - DNA, 16 bp, synthetic construct
  misc_feature 1..16: note = Synthetic oligonucleotide
  source 1..16: mol_type = other DNA
gtgtggcctggccata

SEQ ID NO: 391 - DNA, 16 bp, synthetic construct
  misc_feature 1..16: note = Synthetic oligonucleotide
  source 1..16: mol_type = other DNA
cggttggtcaattccg

SEQ ID NO: 392 - DNA, 16 bp, synthetic construct
  misc_feature 1..16: note = Synthetic oligonucleotide
  source 1..16: mol_type = other DNA
cagaggctatcaacaa

SEQ ID NO: 393 - DNA, 16 bp, synthetic construct
  misc_feature 1..16: note = Synthetic oligonucleotide
  source 1..16: mol_type = other DNA
gttctgacaatgacca

SEQ ID NO: 394 - DNA, 16 bp, synthetic construct
  misc_feature 1..16: note = Synthetic oligonucleotide
  source 1..16: mol_type = other DNA
aggaggtgagcctacc

SEQ ID NO: 395 - DNA, 16 bp, synthetic construct
  misc_feature 1..16: note = Synthetic oligonucleotide
  source 1..16: mol_type = other DNA
ttgagtcatttgctag

SEQ ID NO: 396 - DNA, 16 bp, synthetic construct
  misc_feature 1..16: note = Synthetic oligonucleotide
  source 1..16: mol_type = other DNA
gggaggtgacaggtcg

SEQ ID NO: 397 - DNA, 16 bp, synthetic construct
  misc_feature 1..16: note = Synthetic oligonucleotide
  source 1..16: mol_type = other DNA
cccgatacattcccac

SEQ ID NO: 398 - DNA, 16 bp, synthetic construct
  misc_feature 1..16: note = Synthetic oligonucleotide
  source 1..16: mol_type = other DNA
catggtacaggagaag

SEQ ID NO: 399 - DNA, 16 bp, synthetic construct
  misc_feature 1..16: note = Synthetic oligonucleotide
  source 1..16: mol_type = other DNA
gggaggccctattgtg

SEQ ID NO: 400 - DNA, 16 bp, synthetic construct
  misc_feature 1..16: note = Synthetic oligonucleotide
  source 1..16: mol_type = other DNA
tctattgggcctcaga

SEQ ID NO: 401 - DNA, 16 bp, synthetic construct
  misc_feature 1..16: note = Synthetic oligonucleotide
  source 1..16: mol_type = other DNA
catagcacgaagcctc

SEQ ID NO: 402 - DNA, 16 bp, synthetic construct
  misc_feature 1..16: note = Synthetic oligonucleotide
  source 1..16: mol_type = other DNA
tttcatattcacccga

SEQ ID NO: 403 - DNA, 16 bp, synthetic construct
  misc_feature 1..16: note = Synthetic oligonucleotide
  source 1..16: mol_type = other DNA
ggtaaacccaaacagg

SEQ ID NO: 404 - DNA, 16 bp, synthetic construct
  misc_feature 1..16: note = Synthetic oligonucleotide
  source 1..16: mol_type = other DNA
acctgtattcggagac

SEQ ID NO: 405 - DNA, 16 bp, synthetic construct
  misc_feature 1..16: note = Synthetic oligonucleotide
  source 1..16: mol_type = other DNA
gcatcaaaaacctggg

SEQ ID NO: 406 - DNA, 16 bp, synthetic construct
  misc_feature 1..16: note = Synthetic oligonucleotide
  source 1..16: mol_type = other DNA
cttatgcttactccac

SEQ ID NO: 407 - DNA, 16 bp, synthetic construct
  misc_feature 1..16: note = Synthetic oligonucleotide
  source 1..16: mol_type = other DNA
tatgcccatgtttggt

SEQ ID NO: 408 - DNA, 16 bp, synthetic construct
  misc_feature 1..16: note = Synthetic oligonucleotide
  source 1..16: mol_type = other DNA
accctccttgtctcac

SEQ ID NO: 409 - DNA, 16 bp, synthetic construct
  misc_feature 1..16: note = Synthetic oligonucleotide
  source 1..16: mol_type = other DNA
cagctaagaccagtga

SEQ ID NO: 410 - DNA, 16 bp, synthetic construct
  misc_feature 1..16: note = Synthetic oligonucleotide
  source 1..16: mol_type = other DNA
gctgaaaccacctgta

SEQ ID NO: 411 - DNA, 16 bp, synthetic construct
  misc_feature 1..16: note = Synthetic oligonucleotide
  source 1..16: mol_type = other DNA
tcagatgggtacttct

SEQ ID NO: 412 - DNA, 16 bp, synthetic construct
  misc_feature 1..16: note = Synthetic oligonucleotide
  source 1..16: mol_type = other DNA
ggcctttagaacagct

SEQ ID NO: 413 - DNA, 16 bp, synthetic construct
  misc_feature 1..16: note = Synthetic oligonucleotide
  source 1..16: mol_type = other DNA
gtatttcttgatgtgg

SEQ ID NO: 414 - DNA, 16 bp, synthetic construct
  misc_feature 1..16: note = Synthetic oligonucleotide
  source 1..16: mol_type = other DNA
gggcgagcgattgtct

SEQ ID NO: 415 - DNA, 16 bp, synthetic construct
  misc_feature 1..16: note = Synthetic oligonucleotide
  source 1..16: mol_type = other DNA
ttggttgccgtggcaa

SEQ ID NO: 416 - DNA, 16 bp, synthetic construct
  misc_feature 1..16: note = Synthetic oligonucleotide
  source 1..16: mol_type = other DNA
gatcatcttgttttgg

SEQ ID NO: 417 - DNA, 16 bp, synthetic construct
  misc_feature 1..16: note = Synthetic oligonucleotide
  source 1..16: mol_type = other DNA
cttgaggcacctccat

SEQ ID NO: 418 - DNA, 16 bp, synthetic construct
  misc_feature 1..16: note = Synthetic oligonucleotide
  source 1..16: mol_type = other DNA
catgcaaaggagattc

SEQ ID NO: 419 - DNA, 16 bp, synthetic construct
  misc_feature 1..16: note = Synthetic oligonucleotide
  source 1..16: mol_type = other DNA
attctcccttatagct

SEQ ID NO: 420 - DNA, 16 bp, synthetic construct
  misc_feature 1..16: note = Synthetic oligonucleotide
  source 1..16: mol_type = other DNA
cagcgagagtcaccgc

SEQ ID NO: 421 - DNA, 16 bp, synthetic construct
  misc_feature 1..16: note = Synthetic oligonucleotide
  source 1..16: mol_type = other DNA
tgtttcttgccgtgca

SEQ ID NO: 422 - DNA, 16 bp, synthetic construct
  misc_feature 1..16: note = Synthetic oligonucleotide
  source 1..16: mol_type = other DNA
gaagtcagctgccacc

SEQ ID NO: 423 - DNA, 16 bp, synthetic construct
  misc_feature 1..16: note = Synthetic oligonucleotide
  source 1..16: mol_type = other DNA
tggtaggtctacaaag

SEQ ID NO: 424 - DNA, 16 bp, synthetic construct
  misc_feature 1..16: note = Synthetic oligonucleotide
  source 1..16: mol_type = other DNA
gaccattcccagcaga

SEQ ID NO: 425 - DNA, 16 bp, synthetic construct
  misc_feature 1..16: note = Synthetic oligonucleotide
  source 1..16: mol_type = other DNA
tccagatgtgtttagg

SEQ ID NO: 426 - DNA, 16 bp, synthetic construct
  misc_feature 1..16: note = Synthetic oligonucleotide
  source 1..16: mol_type = other DNA
acacatcattgggtta

SEQ ID NO: 427 - DNA, 16 bp, synthetic construct
  misc_feature 1..16: note = Synthetic oligonucleotide
  source 1..16: mol_type = other DNA
gatcacttccatctgc

SEQ ID NO: 428 - DNA, 16 bp, synthetic construct
  misc_feature 1..16: note = Synthetic oligonucleotide
  source 1..16: mol_type = other DNA
atggtgctttggagag

SEQ ID NO: 429 - DNA, 16 bp, synthetic construct
  misc_feature 1..16: note = Synthetic oligonucleotide
  source 1..16: mol_type = other DNA
caagagagtcctcccc

SEQ ID NO: 430 - DNA, 16 bp, synthetic construct
  misc_feature 1..16: note = Synthetic oligonucleotide
  source 1..16: mol_type = other DNA
ggctctaattctatta

SEQ ID NO: 431 - DNA, 16 bp, synthetic construct
  misc_feature 1..16: note = Synthetic oligonucleotide
  source 1..16: mol_type = other DNA
ggaattgtgtgccccc

SEQ ID NO: 432 - DNA, 16 bp, synthetic construct
  misc_feature 1..16: note = Synthetic oligonucleotide
  source 1..16: mol_type = other DNA
gatgtgggacttgttt

SEQ ID NO: 433 - DNA, 16 bp, synthetic construct
  misc_feature 1..16: note = Synthetic oligonucleotide
  source 1..16: mol_type = other DNA
tgtgggagtgcataac

SEQ ID NO: 434 - DNA, 16 bp, synthetic construct
  misc_feature 1..16: note = Synthetic oligonucleotide
  source 1..16: mol_type = other DNA
agtccccaagatatac

SEQ ID NO: 435 - DNA, 16 bp, synthetic construct
  misc_feature 1..16: note = Synthetic oligonucleotide
  source 1..16: mol_type = other DNA
gcctcctccaaggaat

SEQ ID NO: 436 - DNA, 16 bp, synthetic construct
  misc_feature 1..16: note = Synthetic oligonucleotide
  source 1..16: mol_type = other DNA
gttgcaccctcgctcc

SEQ ID NO: 437 - DNA, 16 bp, synthetic construct
  misc_feature 1..16: note = Synthetic oligonucleotide
  source 1..16: mol_type = other DNA
tggtgccagcagccca

SEQ ID NO: 438 - DNA, 16 bp, synthetic construct
  misc_feature 1..16: note = Synthetic oligonucleotide
  source 1..16: mol_type = other DNA
tttctgtactgctggc

SEQ ID NO: 439 - DNA, 16 bp, synthetic construct
  misc_feature 1..16: note = Synthetic oligonucleotide
  source 1..16: mol_type = other DNA
agggcacggagccttc

SEQ ID NO: 440 - DNA, 16 bp, synthetic construct
  misc_feature 1..16: note = Synthetic oligonucleotide
  source 1..16: mol_type = other DNA
cgatggtggtgccttt

SEQ ID NO: 441 - DNA, 16 bp, synthetic construct
  misc_feature 1..16: note = Synthetic oligonucleotide
  source 1..16: mol_type = other DNA
gggtgccagacccatg

SEQ ID NO: 442 - DNA, 16 bp, synthetic construct
  misc_feature 1..16: note = Synthetic oligonucleotide
  source 1..16: mol_type = other DNA
tcccggtcaaagcggc

SEQ ID NO: 443 - DNA, 16 bp, synthetic construct
  misc_feature 1..16: note = Synthetic oligonucleotide
  source 1..16: mol_type = other DNA
accacttctttccgta

SEQ ID NO: 444 - DNA, 16 bp, synthetic construct
  misc_feature 1..16: note = Synthetic oligonucleotide
  source 1..16: mol_type = other DNA
aagttggatatgttct

SEQ ID NO: 445 - DNA, 16 bp, synthetic construct
  misc_feature 1..16: note = Synthetic oligonucleotide
  source 1..16: mol_type = other DNA
gtctgagggcacggat

SEQ ID NO: 446 - DNA, 16 bp, synthetic construct
  misc_feature 1..16: note = Synthetic oligonucleotide
  source 1..16: mol_type = other DNA
tttcagctgagattgg

SEQ ID NO: 447 - DNA, 16 bp, synthetic construct
  misc_feature 1..16: note = Synthetic oligonucleotide
  source 1..16: mol_type = other DNA
aggatgctgggttcat

SEQ ID NO: 448 - DNA, 16 bp, synthetic construct
  misc_feature 1..16: note = Synthetic oligonucleotide
  source 1..16: mol_type = other DNA
cctcatgtaagtgctt

SEQ ID NO: 449 - DNA, 16 bp, synthetic construct
  misc_feature 1..16: note = Synthetic oligonucleotide
  source 1..16: mol_type = other DNA
tggtcacagttcttgg

SEQ ID NO: 450 - DNA, 16 bp, synthetic construct
  misc_feature 1..16: note = Synthetic oligonucleotide
  source 1..16: mol_type = other DNA
actttacctcaccctc

SEQ ID NO: 451 - DNA, 16 bp, synthetic construct
  misc_feature 1..16: note = Synthetic oligonucleotide
  source 1..16: mol_type = other DNA
gcactgccatctgcat

SEQ ID NO: 452 - DNA, 16 bp, synthetic construct
  misc_feature 1..16: note = Synthetic oligonucleotide
  source 1..16: mol_type = other DNA
cggccccccaatatat

SEQ ID NO: 453 - DNA, 16 bp, synthetic construct
  misc_feature 1..16: note = Synthetic oligonucleotide
  source 1..16: mol_type = other DNA
actgttctaactcttg

SEQ ID NO: 454 - DNA, 16 bp, synthetic construct
  misc_feature 1..16: note = Synthetic oligonucleotide
  source 1..16: mol_type = other DNA
aagacttcattcttcg

SEQ ID NO: 455 - DNA, 16 bp, synthetic construct
  misc_feature 1..16: note = Synthetic oligonucleotide
  source 1..16: mol_type = other DNA
accatcatcaggaagc

SEQ ID NO: 456 - DNA, 16 bp, synthetic construct
  misc_feature 1..16: note = Synthetic oligonucleotide
  source 1..16: mol_type = other DNA
gggaccatggccatgg

SEQ ID NO: 457 - DNA, 16 bp, synthetic construct
  misc_feature 1..16: note = Synthetic oligonucleotide
  source 1..16: mol_type = other DNA
agatctgagcttcctc

SEQ ID NO: 458 - DNA, 16 bp, synthetic construct
  misc_feature 1..16: note = Synthetic oligonucleotide
  source 1..16: mol_type = other DNA
ttgatgagtaggtgag

SEQ ID NO: 459 - DNA, 16 bp, synthetic construct
  misc_feature 1..16: note = Synthetic oligonucleotide
  source 1..16: mol_type = other DNA
ttgaatctcatgattg

SEQ ID NO: 460 - DNA, 16 bp, synthetic construct
  misc_feature 1..16: note = Synthetic oligonucleotide
  source 1..16: mol_type = other DNA
tgttgcccccattggg

SEQ ID NO: 461 - DNA, 16 bp, synthetic construct
  misc_feature 1..16: note = Synthetic oligonucleotide
  source 1..16: mol_type = other DNA
tctgccggttggtcaa

SEQ ID NO: 462 - DNA, 16 bp, synthetic construct
  misc_feature 1..16: note = Synthetic oligonucleotide
  source 1..16: mol_type = other DNA
gaatgagcaggtcaga

SEQ ID NO: 463 - DNA, 16 bp, synthetic construct
  misc_feature 1..16: note = Synthetic oligonucleotide
  source 1..16: mol_type = other DNA
ggttctgacaatgacc

SEQ ID NO: 464 - DNA, 16 bp, synthetic construct
  misc_feature 1..16: note = Synthetic oligonucleotide
  source 1..16: mol_type = other DNA
gaggaggtgagcctac

SEQ ID NO: 465 - DNA, 16 bp, synthetic construct
  misc_feature 1..16: note = Synthetic oligonucleotide
  source 1..16: mol_type = other DNA
cttgagtcatttgcta

SEQ ID NO: 466 - DNA, 16 bp, synthetic construct
  misc_feature 1..16: note = Synthetic oligonucleotide
  source 1..16: mol_type = other DNA
cgggaggtgacaggtc

SEQ ID NO: 467 - DNA, 16 bp, synthetic construct
  misc_feature 1..16: note = Synthetic oligonucleotide
  source 1..16: mol_type = other DNA
gcccgatacattccca

SEQ ID NO: 468 - DNA, 16 bp, synthetic construct
  misc_feature 1..16: note = Synthetic oligonucleotide
  source 1..16: mol_type = other DNA
ctcatggtacaggaga

SEQ ID NO: 469 - DNA, 16 bp, synthetic construct
  misc_feature 1..16: note = Synthetic oligonucleotide
  source 1..16: mol_type = other DNA
agggaggccctattgt

SEQ ID NO: 470 - DNA, 16 bp, synthetic construct
  misc_feature 1..16: note = Synthetic oligonucleotide
  source 1..16: mol_type = other DNA
ttctattgggcctcag

SEQ ID NO: 471 - DNA, 16 bp, synthetic construct
  misc_feature 1..16: note = Synthetic oligonucleotide
  source 1..16: mol_type = other DNA
ccatagcacgaagcct

SEQ ID NO: 472 - DNA, 16 bp, synthetic construct
  misc_feature 1..16: note = Synthetic oligonucleotide
  source 1..16: mol_type = other DNA
gtttcatattcacccg

SEQ ID NO: 473 - DNA, 16 bp, synthetic construct
  misc_feature 1..16: note = Synthetic oligonucleotide
  source 1..16: mol_type = other DNA
aggtaaacccaaacag

SEQ ID NO: 474 - DNA, 16 bp, synthetic construct
  misc_feature 1..16: note = Synthetic oligonucleotide
  source 1..16: mol_type = other DNA
cacctgtattcggaga

SEQ ID NO: 475 - DNA, 16 bp, synthetic construct
  misc_feature 1..16: note = Synthetic oligonucleotide
  source 1..16: mol_type = other DNA
agcatcaaaaacctgg

SEQ ID NO: 476 - DNA, 16 bp, synthetic construct
  misc_feature 1..16: note = Synthetic oligonucleotide
  source 1..16: mol_type = other DNA
ccttatgcttactcca

SEQ ID NO: 477 - DNA, 16 bp, synthetic construct
  misc_feature 1..16: note = Synthetic oligonucleotide
  source 1..16: mol_type = other DNA
gtatgcccatgtttgg

SEQ ID NO: 478 - DNA, 16 bp, synthetic construct
  misc_feature 1..16: note = Synthetic oligonucleotide
  source 1..16: mol_type = other DNA
taccctccttgtctca

SEQ ID NO: 479 - DNA, 16 bp, synthetic construct
  misc_feature 1..16: note = Synthetic oligonucleotide
  source 1..16: mol_type = other DNA
tcagctaagaccagtg

SEQ ID NO: 480 - DNA, 16 bp, synthetic construct
  misc_feature 1..16: note = Synthetic oligonucleotide
  source 1..16: mol_type = other DNA
ttgctgaaaccacctg

SEQ ID NO: 481 - DNA, 16 bp, synthetic construct
  misc_feature 1..16: note = Synthetic oligonucleotide
  source 1..16: mol_type = other DNA
atcagatgggtacttc

SEQ ID NO: 482 - DNA, 16 bp, synthetic construct
  misc_feature 1..16: note = Synthetic oligonucleotide
  source 1..16: mol_type = other DNA
aggcctttagaacagc

SEQ ID NO: 483 - DNA, 16 bp, synthetic construct
  misc_feature 1..16: note = Synthetic oligonucleotide
  source 1..16: mol_type = other DNA
cactaaatctgtgtat

SEQ ID NO: 484 - DNA, 16 bp, synthetic construct
  misc_feature 1..16: note = Synthetic oligonucleotide
  source 1..16: mol_type = other DNA
tgggcgagcgattgtc

SEQ ID NO: 485 - DNA, 16 bp, synthetic construct
  misc_feature 1..16: note = Synthetic oligonucleotide
  source 1..16: mol_type = other DNA
cttggttgccgtggca

SEQ ID NO: 486 - DNA, 16 bp, synthetic construct
  misc_feature 1..16: note = Synthetic oligonucleotide
  source 1..16: mol_type = other DNA
ctgttattaaaccaca

SEQ ID NO: 487 - DNA, 16 bp, synthetic construct
  misc_feature 1..16: note = Synthetic oligonucleotide
  source 1..16: mol_type = other DNA
ccttgaggcacctcca

SEQ ID NO: 488 - DNA, 16 bp, synthetic construct
  misc_feature 1..16: note = Synthetic oligonucleotide
  source 1..16: mol_type = other DNA
ccatgcaaaggagatt

SEQ ID NO: 489 - DNA, 16 bp, synthetic construct
  misc_feature 1..16: note = Synthetic oligonucleotide
  source 1..16: mol_type = other DNA
cattctcccttatagc

SEQ ID NO: 490 - DNA, 16 bp, synthetic construct
  misc_feature 1..16: note = Synthetic oligonucleotide
  source 1..16: mol_type = other DNA
acagcgagagtcaccg

SEQ ID NO: 491 - DNA, 16 bp, synthetic construct
  misc_feature 1..16: note = Synthetic oligonucleotide
  source 1..16: mol_type = other DNA
ttgtttcttgccgtgc

SEQ ID NO: 492 - DNA, 16 bp, synthetic construct
  misc_feature 1..16: note = Synthetic oligonucleotide
  source 1..16: mol_type = other DNA
tgaagtcagctgccac

SEQ ID NO: 493 - DNA, 16 bp, synthetic construct
  misc_feature 1..16: note = Synthetic oligonucleotide
  source 1..16: mol_type = other DNA
atggtaggtctacaaa

SEQ ID NO: 494 - DNA, 16 bp, synthetic construct
  misc_feature 1..16: note = Synthetic oligonucleotide
  source 1..16: mol_type = other DNA
attcctgaccattccc

SEQ ID NO: 495 - DNA, 16 bp, synthetic construct
  misc_feature 1..16: note = Synthetic oligonucleotide
  source 1..16: mol_type = other DNA
atccagatgtgtttag

SEQ ID NO: 496 - DNA, 16 bp, synthetic construct
  misc_feature 1..16: note = Synthetic oligonucleotide
  source 1..16: mol_type = other DNA
aacacatcattgggtt

SEQ ID NO: 497 - DNA, 16 bp, synthetic construct
  misc_feature 1..16: note = Synthetic oligonucleotide
  source 1..16: mol_type = other DNA
tgatcacttccatctg

SEQ ID NO: 498 - DNA, 16 bp, synthetic construct
  misc_feature 1..16: note = Synthetic oligonucleotide
  source 1..16: mol_type = other DNA
catggtgctttggaga

SEQ ID NO: 499 - DNA, 16 bp, synthetic construct
  misc_feature 1..16: note = Synthetic oligonucleotide
  source 1..16: mol_type = other DNA
cataagccagcaagag

SEQ ID NO: 500 - DNA, 16 bp, synthetic construct
  misc_feature 1..16: note = Synthetic oligonucleotide
  source 1..16: mol_type = other DNA
gggctctaattctatt

SEQ ID NO: 501 - DNA, 16 bp, synthetic construct
  misc_feature 1..16: note = Synthetic oligonucleotide
  source 1..16: mol_type = other DNA
gggaattgtgtgcccc

SEQ ID NO: 502 - DNA, 16 bp, synthetic construct
  misc_feature 1..16: note = Synthetic oligonucleotide
  source 1..16: mol_type = other DNA
tgatgtgggacttgtt

SEQ ID NO: 503 - DNA, 16 bp, synthetic construct
  misc_feature 1..16: note = Synthetic oligonucleotide
  source 1..16: mol_type = other DNA
gtgtgggagtgcataa

SEQ ID NO: 504 - DNA, 16 bp, synthetic construct
  misc_feature 1..16: note = Synthetic oligonucleotide
  source 1..16: mol_type = other DNA
cagtccccaagatata

SEQ ID NO: 505 - DNA, 16 bp, synthetic construct
  misc_feature 1..16: note = Synthetic oligonucleotide
  source 1..16: mol_type = other DNA
gggcctcctccaagga

SEQ ID NO: 506 - DNA, 16 bp, synthetic construct
  misc_feature 1..16: note = Synthetic oligonucleotide
  source 1..16: mol_type = other DNA
tgttgcaccctcgctc

SEQ ID NO: 507 - DNA, 16 bp, synthetic construct
  misc_feature 1..16: note = Synthetic oligonucleotide
  source 1..16: mol_type = other DNA
atggtgccagcagccc

SEQ ID NO: 508 - DNA, 16 bp, synthetic construct
  misc_feature 1..16: note = Synthetic oligonucleotide
  source 1..16: mol_type = other DNA
gtttctgtactgctgg

SEQ ID NO: 509 - DNA, 16 bp, synthetic construct
  misc_feature 1..16: note = Synthetic oligonucleotide
  source 1..16: mol_type = other DNA
aagggcacggagcctt

SEQ ID NO: 510 - DNA, 16 bp, synthetic construct
  misc_feature 1..16: note = Synthetic oligonucleotide
  source 1..16: mol_type = other DNA
gcgatggtggtgcctt

SEQ ID NO: 511 - DNA, 16 bp, synthetic construct
  misc_feature 1..16: note = Synthetic oligonucleotide
  source 1..16: mol_type = other DNA
agggtgccagacccat

SEQ ID NO: 512 - DNA, 16 bp, synthetic construct
  misc_feature 1..16: note = Synthetic oligonucleotide
  source 1..16: mol_type = other DNA
atcccggtcaaagcgg

SEQ ID NO: 513 - DNA, 16 bp, synthetic construct
  misc_feature 1..16: note = Synthetic oligonucleotide
  source 1..16: mol_type = other DNA
caccacttctttccgt

SEQ ID NO: 514 - DNA, 16 bp, synthetic construct
  misc_feature 1..16: note = Synthetic oligonucleotide
  source 1..16: mol_type = other DNA
gaaagttggatatgtt

SEQ ID NO: 515 - DNA, 16 bp, synthetic construct
  misc_feature 1..16: note = Synthetic oligonucleotide
  source 1..16: mol_type = other DNA
cgtctgagggcacgga

SEQ ID NO: 516 - DNA, 16 bp, synthetic construct
  misc_feature 1..16: note = Synthetic oligonucleotide
  source 1..16: mol_type = other DNA
ctttcagctgagattg

SEQ ID NO: 517 - DNA, 16 bp, synthetic construct
  misc_feature 1..16: note = Synthetic oligonucleotide
  source 1..16: mol_type = other DNA
caggatgctgggttca

SEQ ID NO: 518 - DNA, 16 bp, synthetic construct
  misc_feature 1..16: note = Synthetic oligonucleotide
  source 1..16: mol_type = other DNA
ccctcatgtaagtgct

SEQ ID NO: 519 - DNA, 16 bp, synthetic construct
  misc_feature 1..16: note = Synthetic oligonucleotide
  source 1..16: mol_type = other DNA
gtggtcacagttcttg

SEQ ID NO: 520 - DNA, 16 bp, synthetic construct
  misc_feature 1..16: note = Synthetic oligonucleotide
  source 1..16: mol_type = other DNA
aactttacctcaccct

SEQ ID NO: 521 - DNA, 16 bp, synthetic construct
  misc_feature 1..16: note = Synthetic oligonucleotide
  source 1..16: mol_type = other DNA
tccttgctgcactgcc

SEQ ID NO: 522 - DNA, 16 bp, synthetic construct
  misc_feature 1..16: note = Synthetic oligonucleotide
  source 1..16: mol_type = other DNA
ccggccccccaatata

SEQ ID NO: 523 - DNA, 16 bp, synthetic construct
  misc_feature 1..16: note = Synthetic oligonucleotide
  source 1..16: mol_type = other DNA
caactgttctaactct

SEQ ID NO: 524 - DNA, 16 bp, synthetic construct
  misc_feature 1..16: note = Synthetic oligonucleotide
  source 1..16: mol_type = other DNA
gcccccaggaggacaa

SEQ ID NO: 525 - DNA, 16 bp, synthetic construct
  misc_feature 1..16: note = Synthetic oligonucleotide
  source 1..16: mol_type = other DNA
gaccatcatcaggaag

SEQ ID NO: 526 - DNA, 16 bp, synthetic construct
  misc_feature 1..16: note = Synthetic oligonucleotide
  source 1..16: mol_type = other DNA
cacatactctctggga

SEQ ID NO: 527 - DNA, 16 bp, synthetic construct
  misc_feature 1..16: note = Synthetic oligonucleotide
  source 1..16: mol_type = other DNA
gagatctgagcttcct

SEQ ID NO: 528 - DNA, 16 bp, synthetic construct
  misc_feature 1..16: note = Synthetic oligonucleotide
  source 1..16: mol_type = other DNA
cttgatgagtaggtga

SEQ ID NO: 529 - DNA, 16 bp, synthetic construct
  misc_feature 1..16: note = Synthetic oligonucleotide
  source 1..16: mol_type = other DNA
ttctgttgcccccatt

SEQ ID NO: 530 - DNA, 16 bp, synthetic construct
  misc_feature 1..16: note = Synthetic oligonucleotide
  source 1..16: mol_type = other DNA
ctgggcgagtctgccg

SEQ ID NO: 531 - DNA, 16 bp, synthetic construct
  misc_feature 1..16: note = Synthetic oligonucleotide
  source 1..16: mol_type = other DNA
gtagaatgagcaggtc

SEQ ID NO: 532 - DNA, 16 bp, synthetic construct
  misc_feature 1..16: note = Synthetic oligonucleotide
  source 1..16: mol_type = other DNA
agagtctatacacaga

SEQ ID NO: 533 - DNA, 16 bp, synthetic construct
  misc_feature 1..16: note = Synthetic oligonucleotide
  source 1..16: mol_type = other DNA
gagtaggaaccagcag

SEQ ID NO: 534 - DNA, 16 bp, synthetic construct
  misc_feature 1..16: note = Synthetic oligonucleotide
  source 1..16: mol_type = other DNA
acttgagtcatttgct

SEQ ID NO: 535 - DNA, 16 bp, synthetic construct
  misc_feature 1..16: note = Synthetic oligonucleotide
  source 1..16: mol_type = other DNA
gcgggaggtgacaggt

SEQ ID NO: 536 - DNA, 16 bp, synthetic construct
  misc_feature 1..16: note = Synthetic oligonucleotide
  source 1..16: mol_type = other DNA
ggcccgatacattccc

SEQ ID NO: 537 - DNA, 16 bp, synthetic construct
  misc_feature 1..16: note = Synthetic oligonucleotide
  source 1..16: mol_type = other DNA
tctcatggtacaggag

SEQ ID NO: 538 - DNA, 16 bp, synthetic construct
  misc_feature 1..16: note = Synthetic oligonucleotide
  source 1..16: mol_type = other DNA
tagggaggccctattg

SEQ ID NO: 539 - DNA, 16 bp, synthetic construct
  misc_feature 1..16: note = Synthetic oligonucleotide
  source 1..16: mol_type = other DNA
attctattgggcctca

SEQ ID NO: 540 - DNA, 16 bp, synthetic construct
  misc_feature 1..16: note = Synthetic oligonucleotide
  source 1..16: mol_type = other DNA
caccatagcacgaagc

SEQ ID NO: 541 - DNA, 16 bp, synthetic construct
  misc_feature 1..16: note = Synthetic oligonucleotide
  source 1..16: mol_type = other DNA
agtttcatattcaccc

SEQ ID NO: 542 - DNA, 16 bp, synthetic construct
  misc_feature 1..16: note = Synthetic oligonucleotide
  source 1..16: mol_type = other DNA
caaggtaaacccaaac

SEQ ID NO: 543 - DNA, 16 bp, synthetic construct
  misc_feature 1..16: note = Synthetic oligonucleotide
  source 1..16: mol_type = other DNA
tcacctgtattcggag

SEQ ID NO: 544 - DNA, 16 bp, synthetic construct
  misc_feature 1..16: note = Synthetic oligonucleotide
  source 1..16: mol_type = other DNA
ctaaaagctgatttgc

SEQ ID NO: 545 - DNA, 16 bp, synthetic construct
  misc_feature 1..16: note = Synthetic oligonucleotide
  source 1..16: mol_type = other DNA
tccttatgcttactcc

SEQ ID NO: 546 - DNA, 16 bp, synthetic construct
  misc_feature 1..16: note = Synthetic oligonucleotide
  source 1..16: mol_type = other DNA
catgtatgcccatgtt

SEQ ID NO: 547 - DNA, 16 bp, synthetic construct
  misc_feature 1..16: note = Synthetic oligonucleotide
  source 1..16: mol_type = other DNA
ataccctccttgtctc

SEQ ID NO: 548 - DNA, 16 bp, synthetic construct
  misc_feature 1..16: note = Synthetic oligonucleotide
  source 1..16: mol_type = other DNA
ttcagctaagaccagt

SEQ ID NO: 549 - DNA, 16 bp, synthetic construct
  misc_feature 1..16: note = Synthetic oligonucleotide
  source 1..16: mol_type = other DNA
gttgctgaaaccacct

SEQ ID NO: 550 - DNA, 16 bp, synthetic construct
  misc_feature 1..16: note = Synthetic oligonucleotide
  source 1..16: mol_type = other DNA
tatcagatgggtactt

SEQ ID NO: 551 - DNA, 16 bp, synthetic construct
  misc_feature 1..16: note = Synthetic oligonucleotide
  source 1..16: mol_type = other DNA
gaggcctttagaacag

SEQ ID NO: 552 - DNA, 16 bp, synthetic construct
  misc_feature 1..16: note = Synthetic oligonucleotide
  source 1..16: mol_type = other DNA
gcactaaatctgtgta

SEQ ID NO: 553 - DNA, 16 bp, synthetic construct
  misc_feature 1..16: note = Synthetic oligonucleotide
  source 1..16: mol_type = other DNA
ctgggcgagcgattgt

SEQ ID NO: 554 - DNA, 16 bp, synthetic construct
  misc_feature 1..16: note = Synthetic oligonucleotide
  source 1..16: mol_type = other DNA
acttggttgccgtggc

SEQ ID NO: 555 - DNA, 16 bp, synthetic construct
  misc_feature 1..16: note = Synthetic oligonucleotide
  source 1..16: mol_type = other DNA
cctgttattaaaccac

SEQ ID NO: 556 - DNA, 16 bp, synthetic construct
  misc_feature 1..16: note = Synthetic oligonucleotide
  source 1..16: mol_type = other DNA
tccttgaggcacctcc

SEQ ID NO: 557 - DNA, 16 bp, synthetic construct
  misc_feature 1..16: note = Synthetic oligonucleotide
  source 1..16: mol_type = other DNA
accatgcaaaggagat

SEQ ID NO: 558 - DNA, 16 bp, synthetic construct
  misc_feature 1..16: note = Synthetic oligonucleotide
  source 1..16: mol_type = other DNA
gcattctcccttatag

SEQ ID NO: 559 - DNA, 16 bp, synthetic construct
  misc_feature 1..16: note = Synthetic oligonucleotide
  source 1..16: mol_type = other DNA
gacagcgagagtcacc

SEQ ID NO: 560 - DNA, 16 bp, synthetic construct
  misc_feature 1..16: note = Synthetic oligonucleotide
  source 1..16: mol_type = other DNA
attgtttcttgccgtg

SEQ ID NO: 561 - DNA, 16 bp, synthetic construct
  misc_feature 1..16: note = Synthetic oligonucleotide
  source 1..16: mol_type = other DNA
tcctgaagtcagctgc

SEQ ID NO: 562 - DNA, 16 bp, synthetic construct
  misc_feature 1..16: note = Synthetic oligonucleotide
  source 1..16: mol_type = other DNA
aatggtaggtctacaa

SEQ ID NO: 563 - DNA, 16 bp, synthetic construct
  misc_feature 1..16: note = Synthetic oligonucleotide
  source 1..16: mol_type = other DNA
tattcctgaccattcc

SEQ ID NO: 564 - DNA, 16 bp, synthetic construct
  misc_feature 1..16: note = Synthetic oligonucleotide
  source 1..16: mol_type = other DNA
aatccagatgtgttta

SEQ ID NO: 565 - DNA, 16 bp, synthetic construct
  misc_feature 1..16: note = Synthetic oligonucleotide
  source 1..16: mol_type = other DNA
tcaacacatcattggg

SEQ ID NO: 566 - DNA, 16 bp, synthetic construct
  misc_feature 1..16: note = Synthetic oligonucleotide
  source 1..16: mol_type = other DNA
gtgatcacttccatct

SEQ ID NO: 567 - DNA, 16 bp, synthetic construct
  misc_feature 1..16: note = Synthetic oligonucleotide
  source 1..16: mol_type = other DNA
ccatggtgctttggag

SEQ ID NO: 568 - DNA, 16 bp, synthetic construct
  misc_feature 1..16: note = Synthetic oligonucleotide
  source 1..16: mol_type = other DNA
ccataagccagcaaga

SEQ ID NO: 569 - DNA, 16 bp, synthetic construct
  misc_feature 1..16: note = Synthetic oligonucleotide
  source 1..16: mol_type = other DNA
agggctctaattctat

SEQ ID NO: 570 - DNA, 16 bp, synthetic construct
  misc_feature 1..16: note = Synthetic oligonucleotide
  source 1..16: mol_type = other DNA
agggaattgtgtgccc

SEQ ID NO: 571 - DNA, 16 bp, synthetic construct
  misc_feature 1..16: note = Synthetic oligonucleotide
  source 1..16: mol_type = other DNA
gtgatgtgggacttgt

SEQ ID NO: 572 - DNA, 16 bp, synthetic construct
  misc_feature 1..16: note = Synthetic oligonucleotide
  source 1..16: mol_type = other DNA
agtgtgggagtgcata

SEQ ID NO: 573 - DNA, 16 bp, synthetic construct
  misc_feature 1..16: note = Synthetic oligonucleotide
  source 1..16: mol_type = other DNA
ccagtccccaagatat

SEQ ID NO: 574 - DNA, 16 bp, synthetic construct
  misc_feature 1..16: note = Synthetic oligonucleotide
  source 1..16: mol_type = other DNA
tcgctgcagggcctcc

SEQ ID NO: 575 - DNA, 16 bp, synthetic construct
  misc_feature 1..16: note = Synthetic oligonucleotide
  source 1..16: mol_type = other DNA
ttgttgcaccctcgct

SEQ ID NO: 576 - DNA, 16 bp, synthetic construct
  misc_feature 1..16: note = Synthetic oligonucleotide
  source 1..16: mol_type = other DNA
tctctgggtccatggt

SEQ ID NO: 577 - DNA, 16 bp, synthetic construct
  misc_feature 1..16: note = Synthetic oligonucleotide
  source 1..16: mol_type = other DNA
agtttctgtactgctg

SEQ ID NO: 578 - DNA, 16 bp, synthetic construct
  misc_feature 1..16: note = Synthetic oligonucleotide
  source 1..16: mol_type = other DNA
caagggcacggagcct

SEQ ID NO: 579 - DNA, 16 bp, synthetic construct
  misc_feature 1..16: note = Synthetic oligonucleotide
  source 1..16: mol_type = other DNA
ggcgatggtggtgcct

SEQ ID NO: 580 - DNA, 16 bp, synthetic construct
  misc_feature 1..16: note = Synthetic oligonucleotide
  source 1..16: mol_type = other DNA
ctctgtgaagggtgcc

SEQ ID NO: 581 - DNA, 16 bp, synthetic construct
  misc_feature 1..16: note = Synthetic oligonucleotide
  source 1..16: mol_type = other DNA
aatcccggtcaaagcg

SEQ ID NO: 582 - DNA, 16 bp, synthetic construct
  misc_feature 1..16: note = Synthetic oligonucleotide
  source 1..16: mol_type = other DNA
ccaccacttctttccg

SEQ ID NO: 583 - DNA, 16 bp, synthetic construct
  misc_feature 1..16: note = Synthetic oligonucleotide
  source 1..16: mol_type = other DNA
attgccagctaaggaa

SEQ ID NO: 584 - DNA, 16 bp, synthetic construct
  misc_feature 1..16: note = Synthetic oligonucleotide
  source 1..16: mol_type = other DNA
gattggctctggctcg

SEQ ID NO: 585 - DNA, 16 bp, synthetic construct
  misc_feature 1..16: note = Synthetic oligonucleotide
  source 1..16: mol_type = other DNA
gctttcagctgagatt

SEQ ID NO: 586 - DNA, 16 bp, synthetic construct
  misc_feature 1..16: note = Synthetic oligonucleotide
  source 1..16: mol_type = other DNA
gactcctctgctcatt

SEQ ID NO: 587 - DNA, 16 bp, synthetic construct
  misc_feature 1..16: note = Synthetic oligonucleotide
  source 1..16: mol_type = other DNA
cccctcatgtaagtgc

SEQ ID NO: 588 - DNA, 16 bp, synthetic construct
  misc_feature 1..16: note = Synthetic oligonucleotide
  source 1..16: mol_type = other DNA
gccctgtggtcacagt

SEQ ID NO: 589 - DNA, 16 bp, synthetic construct
  misc_feature 1..16: note = Synthetic oligonucleotide
  source 1..16: mol_type = other DNA
aaactttacctcaccc

SEQ ID NO: 590 - DNA, 16 bp, synthetic construct
  misc_feature 1..16: note = Synthetic oligonucleotide
  source 1..16: mol_type = other DNA
tctccttgctgcactg

SEQ ID NO: 591 - DNA, 16 bp, synthetic construct
  misc_feature 1..16: note = Synthetic oligonucleotide
  source 1..16: mol_type = other DNA
cccggccccccaatat

SEQ ID NO: 592 - DNA, 16 bp, synthetic construct
  misc_feature 1..16: note = Synthetic oligonucleotide
  source 1..16: mol_type = other DNA
ccaactgttctaactc

SEQ ID NO: 593 - DNA, 16 bp, synthetic construct
  misc_feature 1..16: note = Synthetic oligonucleotide
  source 1..16: mol_type = other DNA
atgcccccaggaggac

SEQ ID NO: 594 - DNA, 16 bp, synthetic construct
  misc_feature 1..16: note = Synthetic oligonucleotide
  source 1..16: mol_type = other DNA
caatgaccatcatcag

SEQ ID NO: 595 - DNA, 16 bp, synthetic construct
  misc_feature 1..16: note = Synthetic oligonucleotide
  source 1..16: mol_type = other DNA
tcacatactctctggg

SEQ ID NO: 596 - DNA, 16 bp, synthetic construct
  misc_feature 1..16: note = Synthetic oligonucleotide
  source 1..16: mol_type = other DNA
agagatctgagcttcc

SEQ ID NO: 597 - DNA, 16 bp, synthetic construct
  misc_feature 1..16: note = Synthetic oligonucleotide
  source 1..16: mol_type = other DNA
gcttgatgagtaggtg

SEQ ID NO: 598 - DNA, 16 bp, synthetic construct
  misc_feature 1..16: note = Synthetic oligonucleotide
  source 1..16: mol_type = other DNA
tcctccttgagcagga

SEQ ID NO: 599 - DNA, 16 bp, synthetic construct
  misc_feature 1..16: note = Synthetic oligonucleotide
  source 1..16: mol_type = other DNA
tgaactccttgtacct

SEQ ID NO: 600 - DNA, 16 bp, synthetic construct
  misc_feature 1..16: note = Synthetic oligonucleotide
  source 1..16: mol_type = other DNA
gtcctccctgggcgag

SEQ ID NO: 601 - DNA, 16 bp, synthetic construct
  misc_feature 1..16: note = Synthetic oligonucleotide
  source 1..16: mol_type = other DNA
ccacatttgagattat

SEQ ID NO: 602 - DNA, 16 bp, synthetic construct
  misc_feature 1..16: note = Synthetic oligonucleotide
  source 1..16: mol_type = other DNA
cgggcagccatctgat

SEQ ID NO: 603 - DNA, 16 bp, synthetic construct
  misc_feature 1..16: note = Synthetic oligonucleotide
  source 1..16: mol_type = other DNA
caccctccattctaag

SEQ ID NO: 604 - DNA, 16 bp, synthetic construct
  misc_feature 1..16: note = Synthetic oligonucleotide
  source 1..16: mol_type = other DNA
cacttgagtcatttgc

SEQ ID NO: 605 - DNA, 16 bp, synthetic construct
  misc_feature 1..16: note = Synthetic oligonucleotide
  source 1..16: mol_type = other DNA
agcgggaggtgacagg

SEQ ID NO: 606 - DNA, 16 bp, synthetic construct
  misc_feature 1..16: note = Synthetic oligonucleotide
  source 1..16: mol_type = other DNA
aggcccgatacattcc

SEQ ID NO: 607 - DNA, 16 bp, synthetic construct
  misc_feature 1..16: note = Synthetic oligonucleotide
  source 1..16: mol_type = other DNA
ttctcatggtacagga

SEQ ID NO: 608 - DNA, 16 bp, synthetic construct
  misc_feature 1..16: note = Synthetic oligonucleotide
  source 1..16: mol_type = other DNA
ttagggaggccctatt

SEQ ID NO: 609 - DNA, 16 bp, synthetic construct
  misc_feature 1..16: note = Synthetic oligonucleotide
  source 1..16: mol_type = other DNA
aattctattgggcctc

SEQ ID NO: 610 - DNA, 16 bp, synthetic construct
  misc_feature 1..16: note = Synthetic oligonucleotide
  source 1..16: mol_type = other DNA
tcaccatagcacgaag

SEQ ID NO: 611 - DNA, 16 bp, synthetic construct
  misc_feature 1..16: note = Synthetic oligonucleotide
  source 1..16: mol_type = other DNA
gcagtttcatattcac

SEQ ID NO: 612 - DNA, 16 bp, synthetic construct
  misc_feature 1..16: note = Synthetic oligonucleotide
  source 1..16: mol_type = other DNA
gattttccaacaaggt

SEQ ID NO: 613 - DNA, 16 bp, synthetic construct
  misc_feature 1..16: note = Synthetic oligonucleotide
  source 1..16: mol_type = other DNA
ctcacctgtattcgga

SEQ ID NO: 614 - DNA, 16 bp, synthetic construct
  misc_feature 1..16: note = Synthetic oligonucleotide
  source 1..16: mol_type = other DNA
gcactaaaagctgatt

SEQ ID NO: 615 - DNA, 16 bp, synthetic construct
  misc_feature 1..16: note = Synthetic oligonucleotide
  source 1..16: mol_type = other DNA
gaaatccttatgctta

SEQ ID NO: 616 - DNA, 16 bp, synthetic construct
  misc_feature 1..16: note = Synthetic oligonucleotide
  source 1..16: mol_type = other DNA
ccatgtatgcccatgt

SEQ ID NO: 617 - DNA, 16 bp, synthetic construct
  misc_feature 1..16: note = Synthetic oligonucleotide
  source 1..16: mol_type = other DNA
cataccctccttgtct

SEQ ID NO: 618 - DNA, 16 bp, synthetic construct
  misc_feature 1..16: note = Synthetic oligonucleotide
  source 1..16: mol_type = other DNA
aattcagctaagacca

SEQ ID NO: 619 - DNA, 16 bp, synthetic construct
  misc_feature 1..16: note = Synthetic oligonucleotide
  source 1..16: mol_type = other DNA
agttgctgaaaccacc

SEQ ID NO: 620 - DNA, 16 bp, synthetic construct
  misc_feature 1..16: note = Synthetic oligonucleotide
  source 1..16: mol_type = other DNA
atatcagatgggtact

SEQ ID NO: 621 - DNA, 16 bp, synthetic construct
  misc_feature 1..16: note = Synthetic oligonucleotide
  source 1..16: mol_type = other DNA
cgaggcctttagaaca

SEQ ID NO: 622 - DNA, 16 bp, synthetic construct
  misc_feature 1..16: note = Synthetic oligonucleotide
  source 1..16: mol_type = other DNA
ggcactaaatctgtgt

SEQ ID NO: 623 - DNA, 16 bp, synthetic construct
  misc_feature 1..16: note = Synthetic oligonucleotide
  source 1..16: mol_type = other DNA
gctgggcgagcgattg

SEQ ID NO: 624 - DNA, 16 bp, synthetic construct
  misc_feature 1..16: note = Synthetic oligonucleotide
  source 1..16: mol_type = other DNA
gacttggttgccgtgg

SEQ ID NO: 625 - DNA, 16 bp, synthetic construct
  misc_feature 1..16: note = Synthetic oligonucleotide
  source 1..16: mol_type = other DNA
gcctgttattaaacca

SEQ ID NO: 626 - DNA, 16 bp, synthetic construct
  misc_feature 1..16: note = Synthetic oligonucleotide
  source 1..16: mol_type = other DNA
atccttgaggcacctc

SEQ ID NO: 627 - DNA, 16 bp, synthetic construct
  misc_feature 1..16: note = Synthetic oligonucleotide
  source 1..16: mol_type = other DNA
ctaccatgcaaaggag

SEQ ID NO: 628 - DNA, 16 bp, synthetic construct
  misc_feature 1..16: note = Synthetic oligonucleotide
  source 1..16: mol_type = other DNA
tgcattctcccttata

SEQ ID NO: 629 - DNA, 16 bp, synthetic construct
  misc_feature 1..16: note = Synthetic oligonucleotide
  source 1..16: mol_type = other DNA
agacagcgagagtcac

SEQ ID NO: 630 - DNA, 16 bp, synthetic construct
  misc_feature 1..16: note = Synthetic oligonucleotide
  source 1..16: mol_type = other DNA
aattgtttcttgccgt

SEQ ID NO: 631 - DNA, 16 bp, synthetic construct
  misc_feature 1..16: note = Synthetic oligonucleotide
  source 1..16: mol_type = other DNA
gattactcctgaagtc

SEQ ID NO: 632 - DNA, 16 bp, synthetic construct
  misc_feature 1..16: note = Synthetic oligonucleotide
  source 1..16: mol_type = other DNA
ataatggtaggtctac

SEQ ID NO: 633 - DNA, 16 bp, synthetic construct
  misc_feature 1..16: note = Synthetic oligonucleotide
  source 1..16: mol_type = other DNA
atattcctgaccattc

SEQ ID NO: 634 - DNA, 16 bp, synthetic construct
  misc_feature 1..16: note = Synthetic oligonucleotide
  source 1..16: mol_type = other DNA
gaatccagatgtgttt

SEQ ID NO: 635 - DNA, 16 bp, synthetic construct
  misc_feature 1..16: note = Synthetic oligonucleotide
  source 1..16: mol_type = other DNA
atcaacacatcattgg

SEQ ID NO: 636 - DNA, 16 bp, synthetic construct
  misc_feature 1..16: note = Synthetic oligonucleotide
  source 1..16: mol_type = other DNA
agtgatcacttccatc

SEQ ID NO: 637 - DNA, 16 bp, synthetic construct
  misc_feature 1..16: note = Synthetic oligonucleotide
  source 1..16: mol_type = other DNA
gccatggtgctttgga

SEQ ID NO: 638 - DNA, 16 bp, synthetic construct
  misc_feature 1..16: note = Synthetic oligonucleotide
  source 1..16: mol_type = other DNA
cttccataagccagca

SEQ ID NO: 639 - DNA, 16 bp, synthetic construct
  misc_feature 1..16: note = Synthetic oligonucleotide
  source 1..16: mol_type = other DNA
tagggctctaattcta

SEQ ID NO: 640 - DNA, 16 bp, synthetic construct
  misc_feature 1..16: note = Synthetic oligonucleotide
  source 1..16: mol_type = other DNA
gagggaattgtgtgcc

SEQ ID NO: 641 - DNA, 16 bp, synthetic construct
  misc_feature 1..16: note = Synthetic oligonucleotide
  source 1..16: mol_type = other DNA
tgtgatgtgggacttg

SEQ ID NO: 642 - DNA, 16 bp, synthetic construct
  misc_feature 1..16: note = Synthetic oligonucleotide
  source 1..16: mol_type = other DNA
aagtgtgggagtgcat

SEQ ID NO: 643 - DNA, 16 bp, synthetic construct
  misc_feature 1..16: note = Synthetic oligonucleotide
  source 1..16: mol_type = other DNA
aggtcctccagtcccc

SEQ ID NO: 644 - DNA, 16 bp, synthetic construct
  misc_feature 1..16: note = Synthetic oligonucleotide
  source 1..16: mol_type = other DNA
gtcgctgcagggcctc

SEQ ID NO: 645 - DNA, 16 bp, synthetic construct
  misc_feature 1..16: note = Synthetic oligonucleotide
  source 1..16: mol_type = other DNA
tttgttgcaccctcgc

SEQ ID NO: 646 - DNA, 16 bp, synthetic construct
  misc_feature 1..16: note = Synthetic oligonucleotide
  source 1..16: mol_type = other DNA
gctctctgggtccatg

SEQ ID NO: 647 - DNA, 16 bp, synthetic construct
  misc_feature 1..16: note = Synthetic oligonucleotide
  source 1..16: mol_type = other DNA
cagtttctgtactgct

SEQ ID NO: 648 - DNA, 16 bp, synthetic construct
  misc_feature 1..16: note = Synthetic oligonucleotide
  source 1..16: mol_type = other DNA
gcaagggcacggagcc

SEQ ID NO: 649 - DNA, 16 bp, synthetic construct
  misc_feature 1..16: note = Synthetic oligonucleotide
  source 1..16: mol_type = other DNA
tggcgatggtggtgcc

SEQ ID NO: 650 - DNA, 16 bp, synthetic construct
  misc_feature 1..16: note = Synthetic oligonucleotide
  source 1..16: mol_type = other DNA
cctctgtgaagggtgc

SEQ ID NO: 651 - DNA, 16 bp, synthetic construct
  misc_feature 1..16: note = Synthetic oligonucleotide
  source 1..16: mol_type = other DNA
taatcccggtcaaagc

SEQ ID NO: 652 - DNA, 16 bp, synthetic construct
  misc_feature 1..16: note = Synthetic oligonucleotide
  source 1..16: mol_type = other DNA
tgtccaccacttcttt

SEQ ID NO: 653 - DNA, 16 bp, synthetic construct
  misc_feature 1..16: note = Synthetic oligonucleotide
  source 1..16: mol_type = other DNA
tattgccagctaagga

SEQ ID NO: 654 - DNA, 16 bp, synthetic construct
  misc_feature 1..16: note = Synthetic oligonucleotide
  source 1..16: mol_type = other DNA
agattggctctggctc

SEQ ID NO: 655 - DNA, 16 bp, synthetic construct
  misc_feature 1..16: note = Synthetic oligonucleotide
  source 1..16: mol_type = other DNA
cgctttcagctgagat

SEQ ID NO: 656 - DNA, 16 bp, synthetic construct
  misc_feature 1..16: note = Synthetic oligonucleotide
  source 1..16: mol_type = other DNA
gcttgactcctctgct

SEQ ID NO: 657 - DNA, 16 bp, synthetic construct
  misc_feature 1..16: note = Synthetic oligonucleotide
  source 1..16: mol_type = other DNA
ccccctcatgtaagtg

SEQ ID NO: 658 - DNA, 16 bp, synthetic construct
  misc_feature 1..16: note = Synthetic oligonucleotide
  source 1..16: mol_type = other DNA
atctctcctggtggct

SEQ ID NO: 659 - DNA, 16 bp, synthetic construct
  misc_feature 1..16: note = Synthetic oligonucleotide
  source 1..16: mol_type = other DNA
taaactttacctcacc

SEQ ID NO: 660 - DNA, 16 bp, synthetic construct
  misc_feature 1..16: note = Synthetic oligonucleotide
  source 1..16: mol_type = other DNA
ttctccttgctgcact

SEQ ID NO: 661 - DNA, 16 bp, synthetic construct
  misc_feature 1..16: note = Synthetic oligonucleotide
  source 1..16: mol_type = other DNA
acccggccccccaata

SEQ ID NO: 662 - DNA, 16 bp, synthetic construct
  misc_feature 1..16: note = Synthetic oligonucleotide
  source 1..16: mol_type = other DNA
tccaactgttctaact

SEQ ID NO: 663 - DNA, 16 bp, synthetic construct
  misc_feature 1..16: note = Synthetic oligonucleotide
  source 1..16: mol_type = other DNA
tatgcccccaggagga

SEQ ID NO: 664 - DNA, 16 bp, synthetic construct
  misc_feature 1..16: note = Synthetic oligonucleotide
  source 1..16: mol_type = other DNA
ccccaatgaccatcat

SEQ ID NO: 665 - DNA, 16 bp, synthetic construct
  misc_feature 1..16: note = Synthetic oligonucleotide
  source 1..16: mol_type = other DNA
ggttctcacatactct

SEQ ID NO: 666 - DNA, 16 bp, synthetic construct
  misc_feature 1..16: note = Synthetic oligonucleotide
  source 1..16: mol_type = other DNA
tagagatctgagcttc

SEQ ID NO: 667 - DNA, 16 bp, synthetic construct
  misc_feature 1..16: note = Synthetic oligonucleotide
  source 1..16: mol_type = other DNA
agcttgatgagtaggt

SEQ ID NO: 668 - DNA, 16 bp, synthetic construct
  misc_feature 1..16: note = Synthetic oligonucleotide
  source 1..16: mol_type = other DNA
gcctcctccttgagca

SEQ ID NO: 669 - DNA, 16 bp, synthetic construct
  misc_feature 1..16: note = Synthetic oligonucleotide
  source 1..16: mol_type = other DNA
gatgacctctgaactc

SEQ ID NO: 670 - DNA, 16 bp, synthetic construct
  misc_feature 1..16: note = Synthetic oligonucleotide
  source 1..16: mol_type = other DNA
ggtcctccctgggcga

SEQ ID NO: 671 - DNA, 16 bp, synthetic construct
  misc_feature 1..16: note = Synthetic oligonucleotide
  source 1..16: mol_type = other DNA
gcccacatttgagatt

SEQ ID NO: 672 - DNA, 16 bp, synthetic construct
  misc_feature 1..16: note = Synthetic oligonucleotide
  source 1..16: mol_type = other DNA
aggacgggcagccatc

SEQ ID NO: 673 - DNA, 16 bp, synthetic construct
  misc_feature 1..16: note = Synthetic oligonucleotide
  source 1..16: mol_type = other DNA
ccaccctccattctaa

SEQ ID NO: 674 - DNA, 16 bp, synthetic construct
  misc_feature 1..16: note = Synthetic oligonucleotide
  source 1..16: mol_type = other DNA
ccacttgagtcatttg

SEQ ID NO: 675 - DNA, 16 bp, synthetic construct
  misc_feature 1..16: note = Synthetic oligonucleotide
  source 1..16: mol_type = other DNA
gagcgggaggtgacag

SEQ ID NO: 676 - DNA, 16 bp, synthetic construct
  misc_feature 1..16: note = Synthetic oligonucleotide
  source 1..16: mol_type = other DNA
caggcccgatacattc

SEQ ID NO: 677 - DNA, 16 bp, synthetic construct
  misc_feature 1..16: note = Synthetic oligonucleotide
  source 1..16: mol_type = other DNA
attctcatggtacagg

SEQ ID NO: 678 - DNA, 16 bp, synthetic construct
  misc_feature 1..16: note = Synthetic oligonucleotide
  source 1..16: mol_type = other DNA
cttagggaggccctat

SEQ ID NO: 679 - DNA, 16 bp, synthetic construct
  misc_feature 1..16: note = Synthetic oligonucleotide
  source 1..16: mol_type = other DNA
aaattctattgggcct

SEQ ID NO: 680 - DNA, 16 bp, synthetic construct
  misc_feature 1..16: note = Synthetic oligonucleotide
  source 1..16: mol_type = other DNA
ttcaccatagcacgaa

SEQ ID NO: 681 - DNA, 16 bp, synthetic construct
  misc_feature 1..16: note = Synthetic oligonucleotide
  source 1..16: mol_type = other DNA
ccttactgcagtttca

SEQ ID NO: 682 - DNA, 16 bp, synthetic construct
  misc_feature 1..16: note = Synthetic oligonucleotide
  source 1..16: mol_type = other DNA
gggattttccaacaag

SEQ ID NO: 683 - DNA, 16 bp, synthetic construct
  misc_feature 1..16: note = Synthetic oligonucleotide
  source 1..16: mol_type = other DNA
tctcacctgtattcgg

SEQ ID NO: 684 - DNA, 16 bp, synthetic construct
  misc_feature 1..16: note = Synthetic oligonucleotide
  source 1..16: mol_type = other DNA
tgcactaaaagctgat

SEQ ID NO: 685 - DNA, 16 bp, synthetic construct
  misc_feature 1..16: note = Synthetic oligonucleotide
  source 1..16: mol_type = other DNA
cagaaatccttatgct

SEQ ID NO: 686 - DNA, 16 bp, synthetic construct
  misc_feature 1..16: note = Synthetic oligonucleotide
  source 1..16: mol_type = other DNA
tccatgtatgcccatg

SEQ ID NO: 687 - DNA, 16 bp, synthetic construct
  misc_feature 1..16: note = Synthetic oligonucleotide
  source 1..16: mol_type = other DNA
cactcaatcataccct

SEQ ID NO: 688 - DNA, 16 bp, synthetic construct
  misc_feature 1..16: note = Synthetic oligonucleotide
  source 1..16: mol_type = other DNA
caattcagctaagacc

SEQ ID NO: 689 - DNA, 16 bp, synthetic construct
  misc_feature 1..16: note = Synthetic oligonucleotide
  source 1..16: mol_type = other DNA
ggagttgctgaaacca

SEQ ID NO: 690 - DNA, 16 bp, synthetic construct
  misc_feature 1..16: note = Synthetic oligonucleotide
  source 1..16: mol_type = other DNA
catatcagatgggtac

SEQ ID NO: 691 - DNA, 16 bp, synthetic construct
  misc_feature 1..16: note = Synthetic oligonucleotide
  source 1..16: mol_type = other DNA
acgaggcctttagaac

SEQ ID NO: 692 - DNA, 16 bp, synthetic construct
  misc_feature 1..16: note = Synthetic oligonucleotide
  source 1..16: mol_type = other DNA
ctctggcactaaatct

SEQ ID NO: 693 - DNA, 16 bp, synthetic construct
  misc_feature 1..16: note = Synthetic oligonucleotide
  source 1..16: mol_type = other DNA
ggctgggcgagcgatt

SEQ ID NO: 694 - DNA, 16 bp, synthetic construct
  misc_feature 1..16: note = Synthetic oligonucleotide
  source 1..16: mol_type = other DNA
tgacttggttgccgtg

SEQ ID NO: 695 - DNA, 16 bp, synthetic construct
  misc_feature 1..16: note = Synthetic oligonucleotide
  source 1..16: mol_type = other DNA
ggcctgttattaaacc

SEQ ID NO: 696 - DNA, 16 bp, synthetic construct
  misc_feature 1..16: note = Synthetic oligonucleotide
  source 1..16: mol_type = other DNA
gatccttgaggcacct

SEQ ID NO: 697 - DNA, 16 bp, synthetic construct
  misc_feature 1..16: note = Synthetic oligonucleotide
  source 1..16: mol_type = other DNA
actaccatgcaaagga

SEQ ID NO: 698 - DNA, 16 bp, synthetic construct
  misc_feature 1..16: note = Synthetic oligonucleotide
  source 1..16: mol_type = other DNA
ctccttatgttttgaa

SEQ ID NO: 699 - DNA, 16 bp, synthetic construct
  misc_feature 1..16: note = Synthetic oligonucleotide
  source 1..16: mol_type = other DNA
cagacagcgagagtca

SEQ ID NO: 700 - DNA, 16 bp, synthetic construct
  misc_feature 1..16: note = Synthetic oligonucleotide
  source 1..16: mol_type = other DNA
aaattgtttcttgccg

SEQ ID NO: 701 - DNA, 16 bp, synthetic construct
  misc_feature 1..16: note = Synthetic oligonucleotide
  source 1..16: mol_type = other DNA
ggattactcctgaagt

SEQ ID NO: 702 - DNA, 16 bp, synthetic construct
  misc_feature 1..16: note = Synthetic oligonucleotide
  source 1..16: mol_type = other DNA
aataatggtaggtcta

SEQ ID NO: 703 - DNA, 16 bp, synthetic construct
  misc_feature 1..16: note = Synthetic oligonucleotide
  source 1..16: mol_type = other DNA
tatattcctgaccatt

SEQ ID NO: 704 - DNA, 16 bp, synthetic construct
  misc_feature 1..16: note = Synthetic oligonucleotide
  source 1..16: mol_type = other DNA
ggaatccagatgtgtt

SEQ ID NO: 705 - DNA, 16 bp, synthetic construct
  misc_feature 1..16: note = Synthetic oligonucleotide
  source 1..16: mol_type = other DNA
tatcaacacatcattg

SEQ ID NO: 706 - DNA, 16 bp, synthetic construct
  misc_feature 1..16: note = Synthetic oligonucleotide
  source 1..16: mol_type = other DNA
cagtgatcacttccat

SEQ ID NO: 707 - DNA, 16 bp, synthetic construct
  misc_feature 1..16: note = Synthetic oligonucleotide
  source 1..16: mol_type = other DNA
acattgaaacaccagg

SEQ ID NO: 708 - DNA, 16 bp, synthetic construct
  misc_feature 1..16: note = Synthetic oligonucleotide
  source 1..16: mol_type = other DNA
gcttccataagccagc

SEQ ID NO: 709 - DNA, 16 bp, synthetic construct
  misc_feature 1..16: note = Synthetic oligonucleotide
  source 1..16: mol_type = other DNA
gtagggctctaattct

SEQ ID NO: 710 - DNA, 16 bp, synthetic construct
  misc_feature 1..16: note = Synthetic oligonucleotide
  source 1..16: mol_type = other DNA
agagggaattgtgtgc

SEQ ID NO: 711 - DNA, 16 bp, synthetic construct
  misc_feature 1..16: note = Synthetic oligonucleotide
  source 1..16: mol_type = other DNA
ctgtgatgtgggactt

SEQ ID NO: 712 - DNA, 16 bp, synthetic construct
  misc_feature 1..16: note = Synthetic oligonucleotide
  source 1..16: mol_type = other DNA
aaagtgtgggagtgca

SEQ ID NO: 713 - DNA, 16 bp, synthetic construct
  misc_feature 1..16: note = Synthetic oligonucleotide
  source 1..16: mol_type = other DNA
aggaattcgaaaggga

SEQ ID NO: 714 - DNA, 16 bp, synthetic construct
  misc_feature 1..16: note = Synthetic oligonucleotide
  source 1..16: mol_type = other DNA
ataataaccagacagg

SEQ ID NO: 715 - DNA, 16 bp, synthetic construct
  misc_feature 1..16: note = Synthetic oligonucleotide
  source 1..16: mol_type = other DNA
gcactcatccagatgc

SEQ ID NO: 716 - DNA, 16 bp, synthetic construct
  misc_feature 1..16: note = Synthetic oligonucleotide
  source 1..16: mol_type = other DNA
tccagtatctgtccca

SEQ ID NO: 717 - DNA, 16 bp, synthetic construct
  misc_feature 1..16: note = Synthetic oligonucleotide
  source 1..16: mol_type = other DNA
gtgtgctcactttttc

SEQ ID NO: 718 - DNA, 16 bp, synthetic construct
  misc_feature 1..16: note = Synthetic oligonucleotide
  source 1..16: mol_type = other DNA
gttatcctcaagctca

SEQ ID NO: 719 - DNA, 16 bp, synthetic construct
  misc_feature 1..16: note = Synthetic oligonucleotide
  source 1..16: mol_type = other DNA
accttctgaaccccat

SEQ ID NO: 720 - DNA, 16 bp, synthetic construct
  misc_feature 1..16: note = Synthetic oligonucleotide
  source 1..16: mol_type = other DNA
gacgagggtcaggatg

SEQ ID NO: 721 - DNA, 16 bp, synthetic construct
  misc_feature 1..16: note = Synthetic oligonucleotide
  source 1..16: mol_type = other DNA
catcccaggttccaag

SEQ ID NO: 722 - DNA, 16 bp, synthetic construct
  misc_feature 1..16: note = Synthetic oligonucleotide
  source 1..16: mol_type = other DNA
atggtactgctggtaa

SEQ ID NO: 723 - DNA, 16 bp, synthetic construct
  misc_feature 1..16: note = Synthetic oligonucleotide
  source 1..16: mol_type = other DNA
ggcttgggcttgtgtc

SEQ ID NO: 724 - DNA, 16 bp, synthetic construct
  misc_feature 1..16: note = Synthetic oligonucleotide
  source 1..16: mol_type = other DNA
gtgtgagttggtaagt

SEQ ID NO: 725 - DNA, 16 bp, synthetic construct
  misc_feature 1..16: note = Synthetic oligonucleotide
  source 1..16: mol_type = other DNA
atgcggtactgactga

SEQ ID NO: 726 - DNA, 16 bp, synthetic construct
  misc_feature 1..16: note = Synthetic oligonucleotide
  source 1..16: mol_type = other DNA
cacctgttcaccgctt

SEQ ID NO: 727 - DNA, 16 bp, synthetic construct
  misc_feature 1..16: note = Synthetic oligonucleotide
  source 1..16: mol_type = other DNA
gccacatccgtgagct

SEQ ID NO: 728 - DNA, 16 bp, synthetic construct
  misc_feature 1..16: note = Synthetic oligonucleotide
  source 1..16: mol_type = other DNA
cctgcagaatcttata

SEQ ID NO: 729 - DNA, 16 bp, synthetic construct
  misc_feature 1..16: note = Synthetic oligonucleotide
  source 1..16: mol_type = other DNA
ccctgccaggcatatc

SEQ ID NO: 730 - DNA, 16 bp, synthetic construct
  misc_feature 1..16: note = Synthetic oligonucleotide
  source 1..16: mol_type = other DNA
ccaaagtccctaacac

SEQ ID NO: 731 - DNA, 16 bp, synthetic construct
  misc_feature 1..16: note = Synthetic oligonucleotide
  source 1..16: mol_type = other DNA
tattgcaggctccaat

SEQ ID NO: 732 - DNA, 16 bp, synthetic construct
  misc_feature 1..16: note = Synthetic oligonucleotide
  source 1..16: mol_type = other DNA
tcttccgtcaatatat

SEQ ID NO: 733 - DNA, 16 bp, synthetic construct
  misc_feature 1..16: note = Synthetic oligonucleotide
  source 1..16: mol_type = other DNA
tgggtctgtagtggag

SEQ ID NO: 734 - DNA, 16 bp, synthetic construct
  misc_feature 1..16: note = Synthetic oligonucleotide
  source 1..16: mol_type = other DNA
tgcctgactgagatat

SEQ ID NO: 735 - DNA, 16 bp, synthetic construct
  misc_feature 1..16: note = Synthetic oligonucleotide
  source 1..16: mol_type = other DNA
ccatcacatgacaacc

SEQ ID NO: 736 - DNA, 16 bp, synthetic construct
  misc_feature 1..16: note = Synthetic oligonucleotide
  source 1..16: mol_type = other DNA
ccgggtaagagcgatg

SEQ ID NO: 737 - DNA, 16 bp, synthetic construct
  misc_feature 1..16: note = Synthetic oligonucleotide
  source 1..16: mol_type = other DNA
cggcgacaagacagct

SEQ ID NO: 738 - DNA, 16 bp, synthetic construct
  misc_feature 1..16: note = Synthetic oligonucleotide
  source 1..16: mol_type = other DNA
agcaaacacgctcccc

SEQ ID NO: 739 - DNA, 16 bp, synthetic construct
  misc_feature 1..16: note = Synthetic oligonucleotide
  source 1..16: mol_type = other DNA
gcaacgcacccttctc

SEQ ID NO: 740 - DNA, 16 bp, synthetic construct
  misc_feature 1..16: note = Synthetic oligonucleotide
  source 1..16: mol_type = other DNA
acaggcttcatcatct

SEQ ID NO: 741 - DNA, 16 bp, synthetic construct
  misc_feature 1..16: note = Synthetic oligonucleotide
  source 1..16: mol_type = other DNA
agcctctgctgaatat

SEQ ID NO: 742 - DNA, 16 bp, synthetic construct
  misc_feature 1..16: note = Synthetic oligonucleotide
  source 1..16: mol_type = other DNA
gatcttgccagatgcc

SEQ ID NO: 743 - DNA, 16 bp, synthetic construct
  misc_feature 1..16: note = Synthetic oligonucleotide
  source 1..16: mol_type = other DNA
atcactgagcccccat

SEQ ID NO: 744 - DNA, 16 bp, synthetic construct
  misc_feature 1..16: note = Synthetic oligonucleotide
  source 1..16: mol_type = other DNA
tcaccctaaggagagg

SEQ ID NO: 745 - DNA, 16 bp, synthetic construct
  misc_feature 1..16: note = Synthetic oligonucleotide
  source 1..16: mol_type = other DNA
acttccccaaggatgt

SEQ ID NO: 746 - DNA, 16 bp, synthetic construct
  misc_feature 1..16: note = Synthetic oligonucleotide
  source 1..16: mol_type = other DNA
agggtcagcttggagc

SEQ ID NO: 747 - DNA, 16 bp, synthetic construct
  misc_feature 1..16: note = Synthetic oligonucleotide
  source 1..16: mol_type = other DNA
gttaagctggaagctg

SEQ ID NO: 748 - DNA, 16 bp, synthetic construct
  misc_feature 1..16: note = Synthetic oligonucleotide
  source 1..16: mol_type = other DNA
agccgtgttatatttg

SEQ ID NO: 749 - DNA, 16 bp, synthetic construct
  misc_feature 1..16: note = Synthetic oligonucleotide
  source 1..16: mol_type = other DNA
tgccctaacacagctg

SEQ ID NO: 750 - DNA, 16 bp, synthetic construct
  misc_feature 1..16: note = Synthetic oligonucleotide
  source 1..16: mol_type = other DNA
ttcccaattcagcaat

SEQ ID NO: 751 - DNA, 16 bp, synthetic construct
  misc_feature 1..16: note = Synthetic oligonucleotide
  source 1..16: mol_type = other DNA
ttgtctccgacacttt

SEQ ID NO: 752 - DNA, 16 bp, synthetic construct
  misc_feature 1..16: note = Synthetic oligonucleotide
  source 1..16: mol_type = other DNA
aagtgcaaccaatcaa

SEQ ID NO: 753 - DNA, 16 bp, synthetic construct
  misc_feature 1..16: note = Synthetic oligonucleotide
  source 1..16: mol_type = other DNA
ctaaactcacactggc

SEQ ID NO: 754 - DNA, 16 bp, synthetic construct
  misc_feature 1..16: note = Synthetic oligonucleotide
  source 1..16: mol_type = other DNA
ctaagttccggtctca

SEQ ID NO: 755 - DNA, 16 bp, synthetic construct
  misc_feature 1..16: note = Synthetic oligonucleotide
  source 1..16: mol_type = other DNA
actccactgggcccga

SEQ ID NO: 756 - DNA, 16 bp, synthetic construct
  misc_feature 1..16: note = Synthetic oligonucleotide
  source 1..16: mol_type = other DNA
gcattgccctcccaat

SEQ ID NO: 757 - DNA, 16 bp, synthetic construct
  misc_feature 1..16: note = Synthetic oligonucleotide
  source 1..16: mol_type = other DNA
caccacagccgttcca

SEQ ID NO: 758 - DNA, 16 bp, synthetic construct
  misc_feature 1..16: note = Synthetic oligonucleotide
  source 1..16: mol_type = other DNA
ctgggtctgacccacg

SEQ ID NO: 759 - DNA, 16 bp, synthetic construct
  misc_feature 1..16: note = Synthetic oligonucleotide
  source 1..16: mol_type = other DNA
caggatcctgacaaac

SEQ ID NO: 760 - DNA, 16 bp, synthetic construct
  misc_feature 1..16: note = Synthetic oligonucleotide
  source 1..16: mol_type = other DNA
caggttcacatgacag

SEQ ID NO: 761 - DNA, 16 bp, synthetic construct
  misc_feature 1..16: note = Synthetic oligonucleotide
  source 1..16: mol_type = other DNA
aactgcaagctatggg

SEQ ID NO: 762 - DNA, 16 bp, synthetic construct
  misc_feature 1..16: note = Synthetic oligonucleotide
  source 1..16: mol_type = other DNA
gacaggcaatacctac

SEQ ID NO: 763 - DNA, 16 bp, synthetic construct
  misc_feature 1..16: note = Synthetic oligonucleotide
  source 1..16: mol_type = other DNA
ggatggaaggaacctc

SEQ ID NO: 764 - DNA, 16 bp, synthetic construct
  misc_feature 1..16: note = Synthetic oligonucleotide
  source 1..16: mol_type = other DNA
tgaacgcaatgctgac

SEQ ID NO: 765 - DNA, 16 bp, synthetic construct
  misc_feature 1..16: note = Synthetic oligonucleotide
  source 1..16: mol_type = other DNA
gctctcggcttctaat

SEQ ID NO: 766 - DNA, 16 bp, synthetic construct
  misc_feature 1..16: note = Synthetic oligonucleotide
  source 1..16: mol_type = other DNA
cggctctccactgtca

SEQ ID NO: 767 - DNA, 16 bp, synthetic construct
  misc_feature 1..16: note = Synthetic oligonucleotide
  source 1..16: mol_type = other DNA
gcactctcagatgggc

SEQ ID NO: 768 - DNA, 16 bp, synthetic construct
  misc_feature 1..16: note = Synthetic oligonucleotide
  source 1..16: mol_type = other DNA
acagcattgagtacaa

SEQ ID NO: 769 - DNA, 16 bp, synthetic construct
  misc_feature 1..16: note = Synthetic oligonucleotide
  source 1..16: mol_type = other DNA
atcaagcaggaagctc

SEQ ID NO: 770 - DNA, 16 bp, synthetic construct
  misc_feature 1..16: note = Synthetic oligonucleotide
  source 1..16: mol_type = other DNA
ccggccacctcattct

SEQ ID NO: 771 - DNA, 16 bp, synthetic construct
  misc_feature 1..16: note = Synthetic oligonucleotide
  source 1..16: mol_type = other DNA
ccagtatgtatttgtg

SEQ ID NO: 772 - DNA, 16 bp, synthetic construct
  misc_feature 1..16: note = Synthetic oligonucleotide
  source 1..16: mol_type = other DNA
cagtacagagcaggat

SEQ ID NO: 773 - DNA, 16 bp, synthetic construct
  misc_feature 1..16: note = Synthetic oligonucleotide
  source 1..16: mol_type = other DNA
cacatgtttcaacagt

SEQ ID NO: 774 - DNA, 16 bp, synthetic construct
  misc_feature 1..16: note = Synthetic oligonucleotide
  source 1..16: mol_type = other DNA
tttagaaaggacacgg

SEQ ID NO: 775 - DNA, 16 bp, synthetic construct
  misc_feature 1..16: note = Synthetic oligonucleotide
  source 1..16: mol_type = other DNA
aatatcagagtgtacc

SEQ ID NO: 776 - DNA, 16 bp, synthetic construct
  misc_feature 1..16: note = Synthetic oligonucleotide
  source 1..16: mol_type = other DNA
tcaaacactttatacc

SEQ ID NO: 777 - DNA, 16 bp, synthetic construct
  misc_feature 1..16: note = Synthetic oligonucleotide
  source 1..16: mol_type = other DNA
ggaagtggaaacatcc

SEQ ID NO: 778 - DNA, 16 bp, synthetic construct
  misc_feature 1..16: note = Synthetic oligonucleotide
  source 1..16: mol_type = other DNA
gttgaagtcacccagc

SEQ ID NO: 779 - DNA, 16 bp, synthetic construct
  misc_feature 1..16: note = Synthetic oligonucleotide
  source 1..16: mol_type = other DNA
gactgtgtgagcacac

SEQ ID NO: 780 - DNA, 16 bp, synthetic construct
  misc_feature 1..16: note = Synthetic oligonucleotide
  source 1..16: mol_type = other DNA
catttggagatctggc

SEQ ID NO: 781 - DNA, 16 bp, synthetic construct
  misc_feature 1..16: note = Synthetic oligonucleotide
  source 1..16: mol_type = other DNA
attagtgctatagagg

SEQ ID NO: 782 - DNA, 16 bp, synthetic construct
  misc_feature 1..16: note = Synthetic oligonucleotide
  source 1..16: mol_type = other DNA
ttgcataagagatgac

SEQ ID NO: 783 - DNA, 16 bp, synthetic construct
  misc_feature 1..16: note = Synthetic oligonucleotide
  source 1..16: mol_type = other DNA
gaggaattcgaaaggg

SEQ ID NO: 784 - DNA, 16 bp, synthetic construct
  misc_feature 1..16: note = Synthetic oligonucleotide
  source 1..16: mol_type = other DNA
gtataataaccagaca

SEQ ID NO: 785 - DNA, 16 bp, synthetic construct
  misc_feature 1..16: note = Synthetic oligonucleotide
  source 1..16: mol_type = other DNA
tgcactcatccagatg

SEQ ID NO: 786 - DNA, 16 bp, synthetic construct
  misc_feature 1..16: note = Synthetic oligonucleotide
  source 1..16: mol_type = other DNA
ctccagtatctgtccc

SEQ ID NO: 787 - DNA, 16 bp, synthetic construct
  misc_feature 1..16: note = Synthetic oligonucleotide
  source 1..16: mol_type = other DNA
ggaccttctgaacccc

SEQ ID NO: 788 - DNA, 16 bp, synthetic construct
  misc_feature 1..16: note = Synthetic oligonucleotide
  source 1..16: mol_type = other DNA
cgacgagggtcaggat

SEQ ID NO: 789 - DNA, 16 bp, synthetic construct
  misc_feature 1..16: note = Synthetic oligonucleotide
  source 1..16: mol_type = other DNA
ccatcccaggttccaa

SEQ ID NO: 790 - DNA, 16 bp, synthetic construct
  misc_feature 1..16: note = Synthetic oligonucleotide
  source 1..16: mol_type = other DNA
catggtactgctggta

SEQ ID NO: 791 - DNA, 16 bp, synthetic construct
  misc_feature 1..16: note = Synthetic oligonucleotide
  source 1..16: mol_type = other DNA
tttgatgaccaggtcg

SEQ ID NO: 792 - DNA, 16 bp, synthetic construct
  misc_feature 1..16: note = Synthetic oligonucleotide
  source 1..16: mol_type = other DNA
cgtgtgagttggtaag

SEQ ID NO: 793 - DNA, 16 bp, synthetic construct
  misc_feature 1..16: note = Synthetic oligonucleotide
  source 1..16: mol_type = other DNA
catgcggtactgactg

SEQ ID NO: 794 - DNA, 16 bp, synthetic construct
  misc_feature 1..16: note = Synthetic oligonucleotide
  source 1..16: mol_type = other DNA
ccacctgttcaccgct

SEQ ID NO: 795 - DNA, 16 bp, synthetic construct
  misc_feature 1..16: note = Synthetic oligonucleotide
  source 1..16: mol_type = other DNA
gggccacatccgtgag

SEQ ID NO: 796 - DNA, 16 bp, synthetic construct
  misc_feature 1..16: note = Synthetic oligonucleotide
  source 1..16: mol_type = other DNA
gccaaagtccctaaca

SEQ ID NO: 797 - DNA, 16 bp, synthetic construct
  misc_feature 1..16: note = Synthetic oligonucleotide
  source 1..16: mol_type = other DNA
ttcttccgtcaatata

SEQ ID NO: 798 - DNA, 16 bp, synthetic construct
  misc_feature 1..16: note = Synthetic oligonucleotide
  source 1..16: mol_type = other DNA
gctgggtctgtagtgg

SEQ ID NO: 799 - DNA, 16 bp, synthetic construct
  misc_feature 1..16: note = Synthetic oligonucleotide
  source 1..16: mol_type = other DNA
ctgcctgactgagata

SEQ ID NO: 800 - DNA, 16 bp, synthetic construct
  misc_feature 1..16: note = Synthetic oligonucleotide
  source 1..16: mol_type = other DNA
cccatcacatgacaac

SEQ ID NO: 801 - DNA, 16 bp, synthetic construct
  misc_feature 1..16: note = Synthetic oligonucleotide
  source 1..16: mol_type = other DNA
accgggtaagagcgat

SEQ ID NO: 802 - DNA, 16 bp, synthetic construct
  misc_feature 1..16: note = Synthetic oligonucleotide
  source 1..16: mol_type = other DNA
gcggcgacaagacagc

SEQ ID NO: 803 - DNA, 16 bp, synthetic construct
  misc_feature 1..16: note = Synthetic oligonucleotide
  source 1..16: mol_type = other DNA
tctgcaacgcaccctt

SEQ ID NO: 804 - DNA, 16 bp, synthetic construct
  misc_feature 1..16: note = Synthetic oligonucleotide
  source 1..16: mol_type = other DNA
ttaccaaggaatcttc

SEQ ID NO: 805 - DNA, 16 bp, synthetic construct
  misc_feature 1..16: note = Synthetic oligonucleotide
  source 1..16: mol_type = other DNA
cgcctccttcaacctt

SEQ ID NO: 806 - DNA, 16 bp, synthetic construct
  misc_feature 1..16: note = Synthetic oligonucleotide
  source 1..16: mol_type = other DNA
gaccctgacctggagc

SEQ ID NO: 807 - DNA, 16 bp, synthetic construct
  misc_feature 1..16: note = Synthetic oligonucleotide
  source 1..16: mol_type = other DNA
gcactggacagcctgt

SEQ ID NO: 808 - DNA, 16 bp, synthetic construct
  misc_feature 1..16: note = Synthetic oligonucleotide
  source 1..16: mol_type = other DNA
ttgtctatcactgagc

SEQ ID NO: 809 - DNA, 16 bp, synthetic construct
  misc_feature 1..16: note = Synthetic oligonucleotide
  source 1..16: mol_type = other DNA
gtcaccctaaggagag

SEQ ID NO: 810 - DNA, 16 bp, synthetic construct
  misc_feature 1..16: note = Synthetic oligonucleotide
  source 1..16: mol_type = other DNA
gctgattccacttccc

SEQ ID NO: 811 - DNA, 16 bp, synthetic construct
  misc_feature 1..16: note = Synthetic oligonucleotide
  source 1..16: mol_type = other DNA
ccccagggtcagcttg

SEQ ID NO: 812 - DNA, 16 bp, synthetic construct
  misc_feature 1..16: note = Synthetic oligonucleotide
  source 1..16: mol_type = other DNA
agttaagctggaagct

SEQ ID NO: 813 - DNA, 16 bp, synthetic construct
  misc_feature 1..16: note = Synthetic oligonucleotide
  source 1..16: mol_type = other DNA
tagccgtgttatattt

SEQ ID NO: 814 - DNA, 16 bp, synthetic construct
  misc_feature 1..16: note = Synthetic oligonucleotide
  source 1..16: mol_type = other DNA
tgaactcagcccctgc

SEQ ID NO: 815 - DNA, 16 bp, synthetic construct
  misc_feature 1..16: note = Synthetic oligonucleotide
  source 1..16: mol_type = other DNA
tttcccaattcagcaa

SEQ ID NO: 816 - DNA, 16 bp, synthetic construct
  misc_feature 1..16: note = Synthetic oligonucleotide
  source 1..16: mol_type = other DNA
cttgtctccgacactt

SEQ ID NO: 817 - DNA, 16 bp, synthetic construct
  misc_feature 1..16: note = Synthetic oligonucleotide
  source 1..16: mol_type = other DNA
taagtgcaaccaatca

SEQ ID NO: 818 - DNA, 16 bp, synthetic construct
  misc_feature 1..16: note = Synthetic oligonucleotide
  source 1..16: mol_type = other DNA
cctaaactcacactgg

SEQ ID NO: 819 - DNA, 16 bp, synthetic construct
  misc_feature 1..16: note = Synthetic oligonucleotide
  source 1..16: mol_type = other DNA
gctaagttccggtctc

SEQ ID NO: 820 - DNA, 16 bp, synthetic construct
  misc_feature 1..16: note = Synthetic oligonucleotide
  source 1..16: mol_type = other DNA
aactccactgggcccg

SEQ ID NO: 821 - DNA, 16 bp, synthetic construct
  misc_feature 1..16: note = Synthetic oligonucleotide
  source 1..16: mol_type = other DNA
actgcattgccctccc

SEQ ID NO: 822 - DNA, 16 bp, synthetic construct
  misc_feature 1..16: note = Synthetic oligonucleotide
  source 1..16: mol_type = other DNA
gcaccacagccgttcc

SEQ ID NO: 823 - DNA, 16 bp, synthetic construct
  misc_feature 1..16: note = Synthetic oligonucleotide
  source 1..16: mol_type = other DNA
acaggatcctgacaaa

SEQ ID NO: 824 - DNA, 16 bp, synthetic construct
  misc_feature 1..16: note = Synthetic oligonucleotide
  source 1..16: mol_type = other DNA
aaactgcaagctatgg

SEQ ID NO: 825 - DNA, 16 bp, synthetic construct
  misc_feature 1..16: note = Synthetic oligonucleotide
  source 1..16: mol_type = other DNA
tggacaggcaatacct

SEQ ID NO: 826 - DNA, 16 bp, synthetic construct
  misc_feature 1..16: note = Synthetic oligonucleotide
  source 1..16: mol_type = other DNA
atgaacgcaatgctga

SEQ ID NO: 827 - DNA, 16 bp, synthetic construct
  misc_feature 1..16: note = Synthetic oligonucleotide
  source 1..16: mol_type = other DNA
tgctctcggcttctaa

SEQ ID NO: 828 - DNA, 16 bp, synthetic construct
  misc_feature 1..16: note = Synthetic oligonucleotide
  source 1..16: mol_type = other DNA
acggctctccactgtc

SEQ ID NO: 829 - DNA, 16 bp, synthetic construct
  misc_feature 1..16: note = Synthetic oligonucleotide
  source 1..16: mol_type = other DNA
ggcactctcagatggg

SEQ ID NO: 830 - DNA, 16 bp, synthetic construct
  misc_feature 1..16: note = Synthetic oligonucleotide
  source 1..16: mol_type = other DNA
cacagcattgagtaca

SEQ ID NO: 831 - DNA, 16 bp, synthetic construct
  misc_feature 1..16: note = Synthetic oligonucleotide
  source 1..16: mol_type = other DNA
accatcaagcaggaag

SEQ ID NO: 832 - DNA, 16 bp, synthetic construct
  misc_feature 1..16: note = Synthetic oligonucleotide
  source 1..16: mol_type = other DNA
cccggccacctcattc

SEQ ID NO: 833 - DNA, 16 bp, synthetic construct
  misc_feature 1..16: note = Synthetic oligonucleotide
  source 1..16: mol_type = other DNA
accagtatgtatttgt

SEQ ID NO: 834 - DNA, 16 bp, synthetic construct
  misc_feature 1..16: note = Synthetic oligonucleotide
  source 1..16: mol_type = other DNA
tcagtacagagcagga

SEQ ID NO: 835 - DNA, 16 bp, synthetic construct
  misc_feature 1..16: note = Synthetic oligonucleotide
  source 1..16: mol_type = other DNA
acacatgtttcaacag

SEQ ID NO: 836 - DNA, 16 bp, synthetic construct
  misc_feature 1..16: note = Synthetic oligonucleotide
  source 1..16: mol_type = other DNA
ttttagaaaggacacg

SEQ ID NO: 837 - DNA, 16 bp, synthetic construct
  misc_feature 1..16: note = Synthetic oligonucleotide
  source 1..16: mol_type = other DNA
aaatatcagagtgtac

SEQ ID NO: 838 - DNA, 16 bp, synthetic construct
  misc_feature 1..16: note = Synthetic oligonucleotide
  source 1..16: mol_type = other DNA
gtcaaacactttatac

SEQ ID NO: 839 - DNA, 16 bp, synthetic construct
  misc_feature 1..16: note = Synthetic oligonucleotide
  source 1..16: mol_type = other DNA
gtgagccttccaggcc

SEQ ID NO: 840 - DNA, 16 bp, synthetic construct
  misc_feature 1..16: note = Synthetic oligonucleotide
  source 1..16: mol_type = other DNA
gatgttgaagtcaccc

SEQ ID NO: 841 - DNA, 16 bp, synthetic construct
  misc_feature 1..16: note = Synthetic oligonucleotide
  source 1..16: mol_type = other DNA
aagactgtgtgagcac

SEQ ID NO: 842 - DNA, 16 bp, synthetic construct
  misc_feature 1..16: note = Synthetic oligonucleotide
  source 1..16: mol_type = other DNA
tacatttggagatctg

SEQ ID NO: 843 - DNA, 16 bp, synthetic construct
  misc_feature 1..16: note = Synthetic oligonucleotide
  source 1..16: mol_type = other DNA
cattagtgctatagag

SEQ ID NO: 844 - DNA, 16 bp, synthetic construct
  misc_feature 1..16: note = Synthetic oligonucleotide
  source 1..16: mol_type = other DNA
attgcataagagatga

SEQ ID NO: 845 - DNA, 16 bp, synthetic construct
  misc_feature 1..16: note = Synthetic oligonucleotide
  source 1..16: mol_type = other DNA
cgaggaattcgaaagg

SEQ ID NO: 846 - DNA, 16 bp, synthetic construct
  misc_feature 1..16: note = Synthetic oligonucleotide
  source 1..16: mol_type = other DNA
tgtataataaccagac

SEQ ID NO: 847 - DNA, 16 bp, synthetic construct
  misc_feature 1..16: note = Synthetic oligonucleotide
  source 1..16: mol_type = other DNA
gtgcactcatccagat

SEQ ID NO: 848 - DNA, 16 bp, synthetic construct
  misc_feature 1..16: note = Synthetic oligonucleotide
  source 1..16: mol_type = other DNA
atctccagtatctgtc

SEQ ID NO: 849 - DNA, 16 bp, synthetic construct
  misc_feature 1..16: note = Synthetic oligonucleotide
  source 1..16: mol_type = other DNA
gattctgtgtgctcac

SEQ ID NO: 850 - DNA, 16 bp, synthetic construct
  misc_feature 1..16: note = Synthetic oligonucleotide
  source 1..16: mol_type = other DNA
atgttatcctcaagct

SEQ ID NO: 851 - DNA, 16 bp, synthetic construct
  misc_feature 1..16: note = Synthetic oligonucleotide
  source 1..16: mol_type = other DNA
tggaccttctgaaccc

SEQ ID NO: 852 - DNA, 16 bp, synthetic construct
  misc_feature 1..16: note = Synthetic oligonucleotide
  source 1..16: mol_type = other DNA
ccgacgagggtcagga

SEQ ID NO: 853 - DNA, 16 bp, synthetic construct
  misc_feature 1..16: note = Synthetic oligonucleotide
  source 1..16: mol_type = other DNA
actccatcccaggttc

SEQ ID NO: 854 - DNA, 16 bp, synthetic construct
  misc_feature 1..16: note = Synthetic oligonucleotide
  source 1..16: mol_type = other DNA
ccatggtactgctggt

SEQ ID NO: 855 - DNA, 16 bp, synthetic construct
  misc_feature 1..16: note = Synthetic oligonucleotide
  source 1..16: mol_type = other DNA
ttttgatgaccaggtc

SEQ ID NO: 856 - DNA, 16 bp, synthetic construct
  misc_feature 1..16: note = Synthetic oligonucleotide
  source 1..16: mol_type = other DNA
ccttcccaatgcctcg

SEQ ID NO: 857 - DNA, 16 bp, synthetic construct
  misc_feature 1..16: note = Synthetic oligonucleotide
  source 1..16: mol_type = other DNA
gcatgcggtactgact

SEQ ID NO: 858 - DNA, 16 bp, synthetic construct
  misc_feature 1..16: note = Synthetic oligonucleotide
  source 1..16: mol_type = other DNA
tccacctgttcaccgc

SEQ ID NO: 859 - DNA, 16 bp, synthetic construct
  misc_feature 1..16: note = Synthetic oligonucleotide
  source 1..16: mol_type = other DNA
tacatccagcacaaga

SEQ ID NO: 860 - DNA, 16 bp, synthetic construct
  misc_feature 1..16: note = Synthetic oligonucleotide
  source 1..16: mol_type = other DNA
cgcctgcagaatctta

SEQ ID NO: 861 - DNA, 16 bp, synthetic construct
  misc_feature 1..16: note = Synthetic oligonucleotide
  source 1..16: mol_type = other DNA
gcccctgccaggcata

SEQ ID NO: 862 - DNA, 16 bp, synthetic construct
  misc_feature 1..16: note = Synthetic oligonucleotide
  source 1..16: mol_type = other DNA
tgccaaagtccctaac

SEQ ID NO: 863 - DNA, 16 bp, synthetic construct
  misc_feature 1..16: note = Synthetic oligonucleotide
  source 1..16: mol_type = other DNA
ttcccttattgcaggc

SEQ ID NO: 864 - DNA, 16 bp, synthetic construct
  misc_feature 1..16: note = Synthetic oligonucleotide
  source 1..16: mol_type = other DNA
attcttccgtcaatat

SEQ ID NO: 865 - DNA, 16 bp, synthetic construct
  misc_feature 1..16: note = Synthetic oligonucleotide
  source 1..16: mol_type = other DNA
ggctgggtctgtagtg

SEQ ID NO: 866 - DNA, 16 bp, synthetic construct
  misc_feature 1..16: note = Synthetic oligonucleotide
  source 1..16: mol_type = other DNA
gctgcctgactgagat

SEQ ID NO: 867 - DNA, 16 bp, synthetic construct
  misc_feature 1..16: note = Synthetic oligonucleotide
  source 1..16: mol_type = other DNA
acccatcacatgacaa

SEQ ID NO: 868 - DNA, 16 bp, synthetic construct
  misc_feature 1..16: note = Synthetic oligonucleotide
  source 1..16: mol_type = other DNA
taccgggtaagagcga

SEQ ID NO: 869 - DNA, 16 bp, synthetic construct
  misc_feature 1..16: note = Synthetic oligonucleotide
  source 1..16: mol_type = other DNA
ggcggcgacaagacag

SEQ ID NO: 870 - DNA, 16 bp, synthetic construct
  misc_feature 1..16: note = Synthetic oligonucleotide
  source 1..16: mol_type = other DNA
acagcaaacacgctcc

SEQ ID NO: 871 - DNA, 16 bp, synthetic construct
  misc_feature 1..16: note = Synthetic oligonucleotide
  source 1..16: mol_type = other DNA
attctgcaacgcaccc

SEQ ID NO: 872 - DNA, 16 bp, synthetic construct
  misc_feature 1..16: note = Synthetic oligonucleotide
  source 1..16: mol_type = other DNA
ctgtccccaacttacc

SEQ ID NO: 873 - DNA, 16 bp, synthetic construct
  misc_feature 1..16: note = Synthetic oligonucleotide
  source 1..16: mol_type = other DNA
tccgcctccttcaacc

SEQ ID NO: 874 - DNA, 16 bp, synthetic construct
  misc_feature 1..16: note = Synthetic oligonucleotide
  source 1..16: mol_type = other DNA
caccctggatcccatc

SEQ ID NO: 875 - DNA, 16 bp, synthetic construct
  misc_feature 1..16: note = Synthetic oligonucleotide
  source 1..16: mol_type = other DNA
ctcttcatcttggtga

SEQ ID NO: 876 - DNA, 16 bp, synthetic construct
  misc_feature 1..16: note = Synthetic oligonucleotide
  source 1..16: mol_type = other DNA
ccagattgtttgtcta

SEQ ID NO: 877 - DNA, 16 bp, synthetic construct
  misc_feature 1..16: note = Synthetic oligonucleotide
  source 1..16: mol_type = other DNA
tgtcaccctaaggaga

SEQ ID NO: 878 - DNA, 16 bp, synthetic construct
  misc_feature 1..16: note = Synthetic oligonucleotide
  source 1..16: mol_type = other DNA
cgctgattccacttcc

SEQ ID NO: 879 - DNA, 16 bp, synthetic construct
  misc_feature 1..16: note = Synthetic oligonucleotide
  source 1..16: mol_type = other DNA
accccagggtcagctt

SEQ ID NO: 880 - DNA, 16 bp, synthetic construct
  misc_feature 1..16: note = Synthetic oligonucleotide
  source 1..16: mol_type = other DNA
cagttaagctggaagc

SEQ ID NO: 881 - DNA, 16 bp, synthetic construct
  misc_feature 1..16: note = Synthetic oligonucleotide
  source 1..16: mol_type = other DNA
gtagccgtgttatatt

SEQ ID NO: 882 - DNA, 16 bp, synthetic construct
  misc_feature 1..16: note = Synthetic oligonucleotide
  source 1..16: mol_type = other DNA
actgaactcagcccct

SEQ ID NO: 883 - DNA, 16 bp, synthetic construct
  misc_feature 1..16: note = Synthetic oligonucleotide
  source 1..16: mol_type = other DNA
gtttcccaattcagca

SEQ ID NO: 884 - DNA, 16 bp, synthetic construct
  misc_feature 1..16: note = Synthetic oligonucleotide
  source 1..16: mol_type = other DNA
ccttgtctccgacact

SEQ ID NO: 885 - DNA, 16 bp, synthetic construct
  misc_feature 1..16: note = Synthetic oligonucleotide
  source 1..16: mol_type = other DNA
gtaagtgcaaccaatc

SEQ ID NO: 886 - DNA, 16 bp, synthetic construct
  misc_feature 1..16: note = Synthetic oligonucleotide
  source 1..16: mol_type = other DNA
ccctaaactcacactg

SEQ ID NO: 887 - DNA, 16 bp, synthetic construct
  misc_feature 1..16: note = Synthetic oligonucleotide
  source 1..16: mol_type = other DNA
ggctaagttccggtct

SEQ ID NO: 888 - DNA, 16 bp, synthetic construct
  misc_feature 1..16: note = Synthetic oligonucleotide
  source 1..16: mol_type = other DNA
aaactccactgggccc

SEQ ID NO: 889 - DNA, 16 bp, synthetic construct
  misc_feature 1..16: note = Synthetic oligonucleotide
  source 1..16: mol_type = other DNA
aactgcattgccctcc

SEQ ID NO: 890 - DNA, 16 bp, synthetic construct
  misc_feature 1..16: note = Synthetic oligonucleotide
  source 1..16: mol_type = other DNA
ccgcaccacagccgtt

SEQ ID NO: 891 - DNA, 16 bp, synthetic construct
  misc_feature 1..16: note = Synthetic oligonucleotide
  source 1..16: mol_type = other DNA
cgctgggtctgaccca

SEQ ID NO: 892 - DNA, 16 bp, synthetic construct
  misc_feature 1..16: note = Synthetic oligonucleotide
  source 1..16: mol_type = other DNA
cacaggatcctgacaa

SEQ ID NO: 893 - DNA, 16 bp, synthetic construct
  misc_feature 1..16: note = Synthetic oligonucleotide
  source 1..16: mol_type = other DNA
agcaggttcacatgac

SEQ ID NO: 894 - DNA, 16 bp, synthetic construct
  misc_feature 1..16: note = Synthetic oligonucleotide
  source 1..16: mol_type = other DNA
cctgaaactgcaagct

SEQ ID NO: 895 - DNA, 16 bp, synthetic construct
  misc_feature 1..16: note = Synthetic oligonucleotide
  source 1..16: mol_type = other DNA
ctggacaggcaatacc

SEQ ID NO: 896 - DNA, 16 bp, synthetic construct
  misc_feature 1..16: note = Synthetic oligonucleotide
  source 1..16: mol_type = other DNA
ttggatggaaggaacc

SEQ ID NO: 897 - DNA, 16 bp, synthetic construct
  misc_feature 1..16: note = Synthetic oligonucleotide
  source 1..16: mol_type = other DNA
aatgaacgcaatgctg

SEQ ID NO: 898 - DNA, 16 bp, synthetic construct
  misc_feature 1..16: note = Synthetic oligonucleotide
  source 1..16: mol_type = other DNA
gtgctctcggcttcta

SEQ ID NO: 899 - DNA, 16 bp, synthetic construct
  misc_feature 1..16: note = Synthetic oligonucleotide
  source 1..16: mol_type = other DNA
cacggctctccactgt

SEQ ID NO: 900 - DNA, 16 bp, synthetic construct
  misc_feature 1..16: note = Synthetic oligonucleotide
  source 1..16: mol_type = other DNA
gggcactctcagatgg

SEQ ID NO: 901 - DNA, 16 bp, synthetic construct
  misc_feature 1..16: note = Synthetic oligonucleotide
  source 1..16: mol_type = other DNA
ccacagcattgagtac

SEQ ID NO: 902 - DNA, 16 bp, synthetic construct
  misc_feature 1..16: note = Synthetic oligonucleotide
  source 1..16: mol_type = other DNA
aaccatcaagcaggaa

SEQ ID NO: 903 - DNA, 16 bp, synthetic construct
  misc_feature 1..16: note = Synthetic oligonucleotide
  source 1..16: mol_type = other DNA
agtgcccggccacctc

SEQ ID NO: 904 - DNA, 16 bp, synthetic construct
  misc_feature 1..16: note = Synthetic oligonucleotide
  source 1..16: mol_type = other DNA
ggaccagtatgtattt

SEQ ID NO: 905 - DNA, 16 bp, synthetic construct
  misc_feature 1..16: note = Synthetic oligonucleotide
  source 1..16: mol_type = other DNA
gtcagtacagagcagg

SEQ ID NO: 906 - DNA, 16 bp, synthetic construct
  misc_feature 1..16: note = Synthetic oligonucleotide
  source 1..16: mol_type = other DNA
cacacatgtttcaaca

SEQ ID NO: 907 - DNA, 16 bp, synthetic construct
  misc_feature 1..16: note = Synthetic oligonucleotide
  source 1..16: mol_type = other DNA
atttccactattttag

SEQ ID NO: 908 - DNA, 16 bp, synthetic construct
  misc_feature 1..16: note = Synthetic oligonucleotide
  source 1..16: mol_type = other DNA
gaaaatatcagagtgt

SEQ ID NO: 909 - DNA, 16 bp, synthetic construct
  misc_feature 1..16: note = Synthetic oligonucleotide
  source 1..16: mol_type = other DNA
ggtcaaacactttata

SEQ ID NO: 910 - DNA, 16 bp, synthetic construct
  misc_feature 1..16: note = Synthetic oligonucleotide
  source 1..16: mol_type = other DNA
agtgagccttccaggc

SEQ ID NO: 911 - DNA, 16 bp, synthetic construct
  misc_feature 1..16: note = Synthetic oligonucleotide
  source 1..16: mol_type = other DNA
agatgttgaagtcacc

SEQ ID NO: 912 - DNA, 16 bp, synthetic construct
  misc_feature 1..16: note = Synthetic oligonucleotide
  source 1..16: mol_type = other DNA
gggacacaagaagact

SEQ ID NO: 913 - DNA, 16 bp, synthetic construct
  misc_feature 1..16: note = Synthetic oligonucleotide
  source 1..16: mol_type = other DNA
ctacatttggagatct

SEQ ID NO: 914 - DNA, 16 bp, synthetic construct
  misc_feature 1..16: note = Synthetic oligonucleotide
  source 1..16: mol_type = other DNA
tcattagtgctataga

SEQ ID NO: 915 - DNA, 16 bp, synthetic construct
  misc_feature 1..16: note = Synthetic oligonucleotide
  source 1..16: mol_type = other DNA
cattgcataagagatg

SEQ ID NO: 916 - DNA, 16 bp, synthetic construct
  misc_feature 1..16: note = Synthetic oligonucleotide
  source 1..16: mol_type = other DNA
ccgaggaattcgaaag

SEQ ID NO: 917 - DNA, 16 bp, synthetic construct
  misc_feature 1..16: note = Synthetic oligonucleotide
  source 1..16: mol_type = other DNA
ctgtataataaccaga

SEQ ID NO: 918 - DNA, 16 bp, synthetic construct
  misc_feature 1..16: note = Synthetic oligonucleotide
  source 1..16: mol_type = other DNA
agtgcactcatccaga

SEQ ID NO: 919 - DNA, 16 bp, synthetic construct
  misc_feature 1..16: note = Synthetic oligonucleotide
  source 1..16: mol_type = other DNA
gatctccagtatctgt

SEQ ID NO: 920 - DNA, 16 bp, synthetic construct
  misc_feature 1..16: note = Synthetic oligonucleotide
  source 1..16: mol_type = other DNA
tatgttatcctcaagc

SEQ ID NO: 921 - DNA, 16 bp, synthetic construct
  misc_feature 1..16: note = Synthetic oligonucleotide
  source 1..16: mol_type = other DNA
gtggaccttctgaacc

SEQ ID NO: 922 - DNA, 16 bp, synthetic construct
  misc_feature 1..16: note = Synthetic oligonucleotide
  source 1..16: mol_type = other DNA
gccgacgagggtcagg

SEQ ID NO: 923 - DNA, 16 bp, synthetic construct
  misc_feature 1..16: note = Synthetic oligonucleotide
  source 1..16: mol_type = other DNA
aactccatcccaggtt

SEQ ID NO: 924 - DNA, 16 bp, synthetic construct
  misc_feature 1..16: note = Synthetic oligonucleotide
  source 1..16: mol_type = other DNA
tccatggtactgctgg

SEQ ID NO: 925 - DNA, 16 bp, synthetic construct
  misc_feature 1..16: note = Synthetic oligonucleotide
  source 1..16: mol_type = other DNA
cttttgatgaccaggt

SEQ ID NO: 926 - DNA, 16 bp, synthetic construct
  misc_feature 1..16: note = Synthetic oligonucleotide
  source 1..16: mol_type = other DNA
gtccttcccaatgcct

SEQ ID NO: 927 - DNA, 16 bp, synthetic construct
  misc_feature 1..16: note = Synthetic oligonucleotide
  source 1..16: mol_type = other DNA
ggcatgcggtactgac

SEQ ID NO: 928 - DNA, 16 bp, synthetic construct
  misc_feature 1..16: note = Synthetic oligonucleotide
  source 1..16: mol_type = other DNA
ctccacctgttcaccg

SEQ ID NO: 929 - DNA, 16 bp, synthetic construct
  misc_feature 1..16: note = Synthetic oligonucleotide
  source 1..16: mol_type = other DNA
ctacatccagcacaag

SEQ ID NO: 930 - DNA, 16 bp, synthetic construct
  misc_feature 1..16: note = Synthetic oligonucleotide
  source 1..16: mol_type = other DNA
ccgcctgcagaatctt

SEQ ID NO: 931 - DNA, 16 bp, synthetic construct
  misc_feature 1..16: note = Synthetic oligonucleotide
  source 1..16: mol_type = other DNA
ttttgtcctggcccct

SEQ ID NO: 932 - DNA, 16 bp, synthetic construct
  misc_feature 1..16: note = Synthetic oligonucleotide
  source 1..16: mol_type = other DNA
atgccaaagtccctaa

SEQ ID NO: 933 - DNA, 16 bp, synthetic construct
  misc_feature 1..16: note = Synthetic oligonucleotide
  source 1..16: mol_type = other DNA
tttcccttattgcagg

SEQ ID NO: 934 - DNA, 16 bp, synthetic construct
  misc_feature 1..16: note = Synthetic oligonucleotide
  source 1..16: mol_type = other DNA
tattcttccgtcaata

SEQ ID NO: 935 - DNA, 16 bp, synthetic construct
  misc_feature 1..16: note = Synthetic oligonucleotide
  source 1..16: mol_type = other DNA
ggacattgaacctggg

SEQ ID NO: 936 - DNA, 16 bp, synthetic construct
  misc_feature 1..16: note = Synthetic oligonucleotide
  source 1..16: mol_type = other DNA
cgctgcctgactgaga

SEQ ID NO: 937 - DNA, 16 bp, synthetic construct
  misc_feature 1..16: note = Synthetic oligonucleotide
  source 1..16: mol_type = other DNA
gacccatcacatgaca

SEQ ID NO: 938 - DNA, 16 bp, synthetic construct
  misc_feature 1..16: note = Synthetic oligonucleotide
  source 1..16: mol_type = other DNA
ttaccgggtaagagcg

SEQ ID NO: 939 - DNA, 16 bp, synthetic construct
  misc_feature 1..16: note = Synthetic oligonucleotide
  source 1..16: mol_type = other DNA
gggcggcgacaagaca

SEQ ID NO: 940 - DNA, 16 bp, synthetic construct
  misc_feature 1..16: note = Synthetic oligonucleotide
  source 1..16: mol_type = other DNA
cacagcaaacacgctc

SEQ ID NO: 941 - DNA, 16 bp, synthetic construct
  misc_feature 1..16: note = Synthetic oligonucleotide
  source 1..16: mol_type = other DNA
cattctgcaacgcacc

SEQ ID NO: 942 - DNA, 16 bp, synthetic construct
  misc_feature 1..16: note = Synthetic oligonucleotide
  source 1..16: mol_type = other DNA
gcaggtcaactgtccc

SEQ ID NO: 943 - DNA, 16 bp, synthetic construct
  misc_feature 1..16: note = Synthetic oligonucleotide
  source 1..16: mol_type = other DNA
atccgcctccttcaac

SEQ ID NO: 944 - DNA, 16 bp, synthetic construct
  misc_feature 1..16: note = Synthetic oligonucleotide
  source 1..16: mol_type = other DNA
attcccccgacacttg

SEQ ID NO: 945 - DNA, 16 bp, synthetic construct
  misc_feature 1..16: note = Synthetic oligonucleotide
  source 1..16: mol_type = other DNA
actcttcatcttggtg

SEQ ID NO: 946 - DNA, 16 bp, synthetic construct
  misc_feature 1..16: note = Synthetic oligonucleotide
  source 1..16: mol_type = other DNA
aacctaaaccagattg

SEQ ID NO: 947 - DNA, 16 bp, synthetic construct
  misc_feature 1..16: note = Synthetic oligonucleotide
  source 1..16: mol_type = other DNA
gtgtcaccctaaggag

SEQ ID NO: 948 - DNA, 16 bp, synthetic construct
  misc_feature 1..16: note = Synthetic oligonucleotide
  source 1..16: mol_type = other DNA
ccgctgattccacttc

SEQ ID NO: 949 - DNA, 16 bp, synthetic construct
  misc_feature 1..16: note = Synthetic oligonucleotide
  source 1..16: mol_type = other DNA
caggtggaaacacccc

SEQ ID NO: 950 - DNA, 16 bp, synthetic construct
  misc_feature 1..16: note = Synthetic oligonucleotide
  source 1..16: mol_type = other DNA
ccagttaagctggaag

SEQ ID NO: 951 - DNA, 16 bp, synthetic construct
  misc_feature 1..16: note = Synthetic oligonucleotide
  source 1..16: mol_type = other DNA
ggtagccgtgttatat

SEQ ID NO: 952 - DNA, 16 bp, synthetic construct
  misc_feature 1..16: note = Synthetic oligonucleotide
  source 1..16: mol_type = other DNA
gactgaactcagcccc

SEQ ID NO: 953 - DNA, 16 bp, synthetic construct
  misc_feature 1..16: note = Synthetic oligonucleotide
  source 1..16: mol_type = other DNA
tgtttcccaattcagc

SEQ ID NO: 954 - DNA, 16 bp, synthetic construct
  misc_feature 1..16: note = Synthetic oligonucleotide
  source 1..16: mol_type = other DNA
accttgtctccgacac

SEQ ID NO: 955 - DNA, 16 bp, synthetic construct
  misc_feature 1..16: note = Synthetic oligonucleotide
  source 1..16: mol_type = other DNA
tgtaagtgcaaccaat

SEQ ID NO: 956 - DNA, 16 bp, synthetic construct
  misc_feature 1..16: note = Synthetic oligonucleotide
  source 1..16: mol_type = other DNA
tccctaaactcacact

SEQ ID NO: 957 - DNA, 16 bp, synthetic construct
  misc_feature 1..16: note = Synthetic oligonucleotide
  source 1..16: mol_type = other DNA
aggctaagttccggtc

SEQ ID NO: 958 - DNA, 16 bp, synthetic construct
  misc_feature 1..16: note = Synthetic oligonucleotide
  source 1..16: mol_type = other DNA
caaactccactgggcc

SEQ ID NO: 959 - DNA, 16 bp, synthetic construct
  misc_feature 1..16: note = Synthetic oligonucleotide
  source 1..16: mol_type = other DNA
aaactgcattgccctc

SEQ ID NO: 960 - DNA, 16 bp, synthetic construct
  misc_feature 1..16: note = Synthetic oligonucleotide
  source 1..16: mol_type = other DNA
cccgcaccacagccgt

SEQ ID NO: 961 - DNA, 16 bp, synthetic construct
  misc_feature 1..16: note = Synthetic oligonucleotide
  source 1..16: mol_type = other DNA
gcgctgggtctgaccc

SEQ ID NO: 962 - DNA, 16 bp, synthetic construct
  misc_feature 1..16: note = Synthetic oligonucleotide
  source 1..16: mol_type = other DNA
ccacaggatcctgaca

SEQ ID NO: 963 - DNA, 16 bp, synthetic construct
  misc_feature 1..16: note = Synthetic oligonucleotide
  source 1..16: mol_type = other DNA
taaagccagctgacag

SEQ ID NO: 964 - DNA, 16 bp, synthetic construct
  misc_feature 1..16: note = Synthetic oligonucleotide
  source 1..16: mol_type = other DNA
ccctgaaactgcaagc

SEQ ID NO: 965 - DNA, 16 bp, synthetic construct
  misc_feature 1..16: note = Synthetic oligonucleotide
  source 1..16: mol_type = other DNA
cctggacaggcaatac

SEQ ID NO: 966 - DNA, 16 bp, synthetic construct
  misc_feature 1..16: note = Synthetic oligonucleotide
  source 1..16: mol_type = other DNA
tttggatggaaggaac

SEQ ID NO: 967 - DNA, 16 bp, synthetic construct
  misc_feature 1..16: note = Synthetic oligonucleotide
  source 1..16: mol_type = other DNA
aaatgaacgcaatgct

SEQ ID NO: 968 - DNA, 16 bp, synthetic construct
  misc_feature 1..16: note = Synthetic oligonucleotide
  source 1..16: mol_type = other DNA
agtgctctcggcttct

SEQ ID NO: 969 - DNA, 16 bp, synthetic construct
  misc_feature 1..16: note = Synthetic oligonucleotide
  source 1..16: mol_type = other DNA
acacggctctccactg

SEQ ID NO: 970 - DNA, 16 bp, synthetic construct
  misc_feature 1..16: note = Synthetic oligonucleotide
  source 1..16: mol_type = other DNA
tgggcactctcagatg

SEQ ID NO: 971 - DNA, 16 bp, synthetic construct
  misc_feature 1..16: note = Synthetic oligonucleotide
  source 1..16: mol_type = other DNA
actccacagcattgag

SEQ ID NO: 972 - DNA, 16 bp, synthetic construct
  misc_feature 1..16: note = Synthetic oligonucleotide
  source 1..16: mol_type = other DNA
aaaccatcaagcagga

SEQ ID NO: 973 - DNA, 16 bp, synthetic construct
  misc_feature 1..16: note = Synthetic oligonucleotide
  source 1..16: mol_type = other DNA
acaagagacctcattc

SEQ ID NO: 974 - DNA, 16 bp, synthetic construct
  misc_feature 1..16: note = Synthetic oligonucleotide
  source 1..16: mol_type = other DNA
gggaccagtatgtatt

SEQ ID NO: 975 - DNA, 16 bp, synthetic construct
  misc_feature 1..16: note = Synthetic oligonucleotide
  source 1..16: mol_type = other DNA
aagtcagtacagagca

SEQ ID NO: 976 - DNA, 16 bp, synthetic construct
  misc_feature 1..16: note = Synthetic oligonucleotide
  source 1..16: mol_type = other DNA
ccacacatgtttcaac

SEQ ID NO: 977 - DNA, 16 bp, synthetic construct
  misc_feature 1..16: note = Synthetic oligonucleotide
  source 1..16: mol_type = other DNA
gaatttccactatttt

SEQ ID NO: 978 - DNA, 16 bp, synthetic construct
  misc_feature 1..16: note = Synthetic oligonucleotide
  source 1..16: mol_type = other DNA
ggttcaaaagcagcat

SEQ ID NO: 979 - DNA, 16 bp, synthetic construct
  misc_feature 1..16: note = Synthetic oligonucleotide
  source 1..16: mol_type = other DNA
gggtcaaacactttat

SEQ ID NO: 980 - DNA, 16 bp, synthetic construct
  misc_feature 1..16: note = Synthetic oligonucleotide
  source 1..16: mol_type = other DNA
aagtgagccttccagg

SEQ ID NO: 981 - DNA, 16 bp, synthetic construct
  misc_feature 1..16: note = Synthetic oligonucleotide
  source 1..16: mol_type = other DNA
cagatgttgaagtcac

SEQ ID NO: 982 - DNA, 16 bp, synthetic construct
  misc_feature 1..16: note = Synthetic oligonucleotide
  source 1..16: mol_type = other DNA
cctattgtaagaacag

SEQ ID NO: 983 - DNA, 16 bp, synthetic construct
  misc_feature 1..16: note = Synthetic oligonucleotide
  source 1..16: mol_type = other DNA
tcaggtgactacattt

SEQ ID NO: 984 - DNA, 16 bp, synthetic construct
  misc_feature 1..16: note = Synthetic oligonucleotide
  source 1..16: mol_type = other DNA
gtcattagtgctatag

SEQ ID NO: 985 - DNA, 16 bp, synthetic construct
  misc_feature 1..16: note = Synthetic oligonucleotide
  source 1..16: mol_type = other DNA
ccattgcataagagat

SEQ ID NO: 986 - DNA, 16 bp, synthetic construct
  misc_feature 1..16: note = Synthetic oligonucleotide
  source 1..16: mol_type = other DNA
accgaggaattcgaaa

SEQ ID NO: 987 - DNA, 16 bp, synthetic construct
  misc_feature 1..16: note = Synthetic oligonucleotide
  source 1..16: mol_type = other DNA
cgtctgtataataacc

SEQ ID NO: 988 - DNA, 16 bp, synthetic construct
  misc_feature 1..16: note = Synthetic oligonucleotide
  source 1..16: mol_type = other DNA
aagtgcactcatccag

SEQ ID NO: 989 - DNA, 16 bp, synthetic construct
  misc_feature 1..16: note = Synthetic oligonucleotide
  source 1..16: mol_type = other DNA
ggatctccagtatctg

SEQ ID NO: 990 - DNA, 16 bp, synthetic construct
  misc_feature 1..16: note = Synthetic oligonucleotide
  source 1..16: mol_type = other DNA
ttatgttatcctcaag

SEQ ID NO: 991 - DNA, 16 bp, synthetic construct
  misc_feature 1..16: note = Synthetic oligonucleotide
  source 1..16: mol_type = other DNA
tgtggaccttctgaac

SEQ ID NO: 992 - DNA, 16 bp, synthetic construct
  misc_feature 1..16: note = Synthetic oligonucleotide
  source 1..16: mol_type = other DNA
tgccgacgagggtcag

SEQ ID NO: 993 - DNA, 16 bp, synthetic construct
  misc_feature 1..16: note = Synthetic oligonucleotide
  source 1..16: mol_type = other DNA
caactccatcccaggt

SEQ ID NO: 994 - DNA, 16 bp, synthetic construct
  misc_feature 1..16: note = Synthetic oligonucleotide
  source 1..16: mol_type = other DNA
agtccatggtactgct

SEQ ID NO: 995 - DNA, 16 bp, synthetic construct
  misc_feature 1..16: note = Synthetic oligonucleotide
  source 1..16: mol_type = other DNA
gcttttgatgaccagg

SEQ ID NO: 996 - DNA, 16 bp, synthetic construct
  misc_feature 1..16: note = Synthetic oligonucleotide
  source 1..16: mol_type = other DNA
tgtccttcccaatgcc

SEQ ID NO: 997 - DNA, 16 bp, synthetic construct
  misc_feature 1..16: note = Synthetic oligonucleotide
  source 1..16: mol_type = other DNA
gaggcatgcggtactg

SEQ ID NO: 998 - DNA, 16 bp, synthetic construct
  misc_feature 1..16: note = Synthetic oligonucleotide
  source 1..16: mol_type = other DNA
tctccacctgttcacc

SEQ ID NO: 999 - DNA, 16 bp, synthetic construct
  misc_feature 1..16: note = Synthetic oligonucleotide
  source 1..16: mol_type = other DNA
agactacatccagcac

SEQ ID NO: 1000 - DNA, 16 bp, synthetic construct
  misc_feature 1..16: note = Synthetic oligonucleotide
  source 1..16: mol_type = other DNA
tccgcctgcagaatct

SEQ ID NO: 1001 - DNA, 16 bp, synthetic construct
  misc_feature 1..16: note = Synthetic oligonucleotide
  source 1..16: mol_type = other DNA
attttgtcctggcccc

SEQ ID NO: 1002 - DNA, 16 bp, synthetic construct
  misc_feature 1..16: note = Synthetic oligonucleotide
  source 1..16: mol_type = other DNA
tggaaatgccaaagtc

SEQ ID NO: 1003 - DNA, 16 bp, synthetic construct
  misc_feature 1..16: note = Synthetic oligonucleotide
  source 1..16: mol_type = other DNA
cagttcccatttttcc

SEQ ID NO: 1004 - DNA, 16 bp, synthetic construct
  misc_feature 1..16: note = Synthetic oligonucleotide
  source 1..16: mol_type = other DNA
ctattcttccgtcaat

SEQ ID NO: 1005 - DNA, 16 bp, synthetic construct
  misc_feature 1..16: note = Synthetic oligonucleotide
  source 1..16: mol_type = other DNA
aggacattgaacctgg

SEQ ID NO: 1006 - DNA, 16 bp, synthetic construct
  misc_feature 1..16: note = Synthetic oligonucleotide
  source 1..16: mol_type = other DNA
ccgctgcctgactgag

SEQ ID NO: 1007 - DNA, 16 bp, synthetic construct
  misc_feature 1..16: note = Synthetic oligonucleotide
  source 1..16: mol_type = other DNA
ggacccatcacatgac

SEQ ID NO: 1008 - DNA, 16 bp, synthetic construct
  misc_feature 1..16: note = Synthetic oligonucleotide
  source 1..16: mol_type = other DNA
cttaccgggtaagagc

SEQ ID NO: 1009 - DNA, 16 bp, synthetic construct
  misc_feature 1..16: note = Synthetic oligonucleotide
  source 1..16: mol_type = other DNA
tgggcggcgacaagac

SEQ ID NO: 1010 - DNA, 16 bp, synthetic construct
  misc_feature 1..16: note = Synthetic oligonucleotide
  source 1..16: mol_type = other DNA
accaagcacagcaaac

SEQ ID NO: 1011 - DNA, 16 bp, synthetic construct
  misc_feature 1..16: note = Synthetic oligonucleotide
  source 1..16: mol_type = other DNA
accattctgcaacgca

SEQ ID NO: 1012 - DNA, 16 bp, synthetic construct
  misc_feature 1..16: note = Synthetic oligonucleotide
  source 1..16: mol_type = other DNA
ggaggcaggtcaactg

SEQ ID NO: 1013 - DNA, 16 bp, synthetic construct
  misc_feature 1..16: note = Synthetic oligonucleotide
  source 1..16: mol_type = other DNA
tgaccacctgtcttgg

SEQ ID NO: 1014 - DNA, 16 bp, synthetic construct
  misc_feature 1..16: note = Synthetic oligonucleotide
  source 1..16: mol_type = other DNA
ggtgcctcggattccc

SEQ ID NO: 1015 - DNA, 16 bp, synthetic construct
  misc_feature 1..16: note = Synthetic oligonucleotide
  source 1..16: mol_type = other DNA
gtgctcaactcttcat

SEQ ID NO: 1016 - DNA, 16 bp, synthetic construct
  misc_feature 1..16: note = Synthetic oligonucleotide
  source 1..16: mol_type = other DNA
ccaagaccaacctaaa

SEQ ID NO: 1017 - DNA, 16 bp, synthetic construct
  misc_feature 1..16: note = Synthetic oligonucleotide
  source 1..16: mol_type = other DNA
cgtgtcaccctaagga

SEQ ID NO: 1018 - DNA, 16 bp, synthetic construct
  misc_feature 1..16: note = Synthetic oligonucleotide
  source 1..16: mol_type = other DNA
cccgctgattccactt

SEQ ID NO: 1019 - DNA, 16 bp, synthetic construct
  misc_feature 1..16: note = Synthetic oligonucleotide
  source 1..16: mol_type = other DNA
tcaggtggaaacaccc

SEQ ID NO: 1020 - DNA, 16 bp, synthetic construct
  misc_feature 1..16: note = Synthetic oligonucleotide
  source 1..16: mol_type = other DNA
tccagttaagctggaa

SEQ ID NO: 1021 - DNA, 16 bp, synthetic construct
  misc_feature 1..16: note = Synthetic oligonucleotide
  source 1..16: mol_type = other DNA
caggtagccgtgttat

SEQ ID NO: 1022 - DNA, 16 bp, synthetic construct
  misc_feature 1..16: note = Synthetic oligonucleotide
  source 1..16: mol_type = other DNA
tgactgaactcagccc

SEQ ID NO: 1023 - DNA, 16 bp, synthetic construct
  misc_feature 1..16: note = Synthetic oligonucleotide
  source 1..16: mol_type = other DNA
gctgtttcccaattca

SEQ ID NO: 1024 - DNA, 16 bp, synthetic construct
  misc_feature 1..16: note = Synthetic oligonucleotide
  source 1..16: mol_type = other DNA
aaccttgtctccgaca

SEQ ID NO: 1025 - DNA, 16 bp, synthetic construct
  misc_feature 1..16: note = Synthetic oligonucleotide
  source 1..16: mol_type = other DNA
ttgtaagtgcaaccaa

SEQ ID NO: 1026 - DNA, 16 bp, synthetic construct
  misc_feature 1..16: note = Synthetic oligonucleotide
  source 1..16: mol_type = other DNA
gacctccctaaactca

SEQ ID NO: 1027 - DNA, 16 bp, synthetic construct
  misc_feature 1..16: note = Synthetic oligonucleotide
  source 1..16: mol_type = other DNA
aaggctaagttccggt

SEQ ID NO: 1028 - DNA, 16 bp, synthetic construct
  misc_feature 1..16: note = Synthetic oligonucleotide
  source 1..16: mol_type = other DNA
gacaagaaccccaaac

SEQ ID NO: 1029 - DNA, 16 bp, synthetic construct
  misc_feature 1..16: note = Synthetic oligonucleotide
  source 1..16: mol_type = other DNA
aaaactgcattgccct

SEQ ID NO: 1030 - DNA, 16 bp, synthetic construct
  misc_feature 1..16: note = Synthetic oligonucleotide
  source 1..16: mol_type = other DNA
acccgcaccacagccg

SEQ ID NO: 1031 - DNA, 16 bp, synthetic construct
  misc_feature 1..16: note = Synthetic oligonucleotide
  source 1..16: mol_type = other DNA
agatccaactcggcgc

SEQ ID NO: 1032 - DNA, 16 bp, synthetic construct
  misc_feature 1..16: note = Synthetic oligonucleotide
  source 1..16: mol_type = other DNA
cccacaggatcctgac

SEQ ID NO: 1033 - DNA, 16 bp, synthetic construct
  misc_feature 1..16: note = Synthetic oligonucleotide
  source 1..16: mol_type = other DNA
cttaaagccagctgac

SEQ ID NO: 1034 - DNA, 16 bp, synthetic construct
  misc_feature 1..16: note = Synthetic oligonucleotide
  source 1..16: mol_type = other DNA
ccccctgaaactgcaa

SEQ ID NO: 1035 - DNA, 16 bp, synthetic construct
  misc_feature 1..16: note = Synthetic oligonucleotide
  source 1..16: mol_type = other DNA
tcctggacaggcaata

SEQ ID NO: 1036 - DNA, 16 bp, synthetic construct
  misc_feature 1..16: note = Synthetic oligonucleotide
  source 1..16: mol_type = other DNA
aggtttggatggaagg

SEQ ID NO: 1037 - DNA, 16 bp, synthetic construct
  misc_feature 1..16: note = Synthetic oligonucleotide
  source 1..16: mol_type = other DNA
gaaatgaacgcaatgc

SEQ ID NO: 1038 - DNA, 16 bp, synthetic construct
  misc_feature 1..16: note = Synthetic oligonucleotide
  source 1..16: mol_type = other DNA
gagtgctctcggcttc

SEQ ID NO: 1039 - DNA, 16 bp, synthetic construct
  misc_feature 1..16: note = Synthetic oligonucleotide
  source 1..16: mol_type = other DNA
tacacggctctccact

SEQ ID NO: 1040 - DNA, 16 bp, synthetic construct
  misc_feature 1..16: note = Synthetic oligonucleotide
  source 1..16: mol_type = other DNA
ttgggcactctcagat

SEQ ID NO: 1041 - DNA, 16 bp, synthetic construct
  misc_feature 1..16: note = Synthetic oligonucleotide
  source 1..16: mol_type = other DNA
aactccacagcattga

SEQ ID NO: 1042 - DNA, 16 bp, synthetic construct
  misc_feature 1..16: note = Synthetic oligonucleotide
  source 1..16: mol_type = other DNA
gcccaaaaccatcaag

SEQ ID NO: 1043 - DNA, 16 bp, synthetic construct
  misc_feature 1..16: note = Synthetic oligonucleotide
  source 1..16: mol_type = other DNA
cacaagagacctcatt

SEQ ID NO: 1044 - DNA, 16 bp, synthetic construct
  misc_feature 1..16: note = Synthetic oligonucleotide
  source 1..16: mol_type = other DNA
tatggaattgcagata

SEQ ID NO: 1045 - DNA, 16 bp, synthetic construct
  misc_feature 1..16: note = Synthetic oligonucleotide
  source 1..16: mol_type = other DNA
caagtcagtacagagc

SEQ ID NO: 1046 - DNA, 16 bp, synthetic construct
  misc_feature 1..16: note = Synthetic oligonucleotide
  source 1..16: mol_type = other DNA
cccacacatgtttcaa

SEQ ID NO: 1047 - DNA, 16 bp, synthetic construct
  misc_feature 1..16: note = Synthetic oligonucleotide
  source 1..16: mol_type = other DNA
agaatttccactattt

SEQ ID NO: 1048 - DNA, 16 bp, synthetic construct
  misc_feature 1..16: note = Synthetic oligonucleotide
  source 1..16: mol_type = other DNA
tggttcaaaagcagca

SEQ ID NO: 1049 - DNA, 16 bp, synthetic construct
  misc_feature 1..16: note = Synthetic oligonucleotide
  source 1..16: mol_type = other DNA
tgggtcaaacacttta

SEQ ID NO: 1050 - DNA, 16 bp, synthetic construct
  misc_feature 1..16: note = Synthetic oligonucleotide
  source 1..16: mol_type = other DNA
gaagtgagccttccag

SEQ ID NO: 1051 - DNA, 16 bp, synthetic construct
  misc_feature 1..16: note = Synthetic oligonucleotide
  source 1..16: mol_type = other DNA
ccagatgttgaagtca

SEQ ID NO: 1052 - DNA, 16 bp, synthetic construct
  misc_feature 1..16: note = Synthetic oligonucleotide
  source 1..16: mol_type = other DNA
tcctattgtaagaaca

SEQ ID NO: 1053 - DNA, 16 bp, synthetic construct
  misc_feature 1..16: note = Synthetic oligonucleotide
  source 1..16: mol_type = other DNA
ctcaggtgactacatt

SEQ ID NO: 1054 - DNA, 16 bp, synthetic construct
  misc_feature 1..16: note = Synthetic oligonucleotide
  source 1..16: mol_type = other DNA
agtcattagtgctata

SEQ ID NO: 1055 - DNA, 16 bp, synthetic construct
  misc_feature 1..16: note = Synthetic oligonucleotide
  source 1..16: mol_type = other DNA
gccattgcataagaga

SEQ ID NO: 1056 - DNA, 16 bp, synthetic construct
  misc_feature 1..16: note = Synthetic oligonucleotide
  source 1..16: mol_type = other DNA
taccgaggaattcgaa

SEQ ID NO: 1057 - DNA, 16 bp, synthetic construct
  misc_feature 1..16: note = Synthetic oligonucleotide
  source 1..16: mol_type = other DNA
cacctccagttatgcg

SEQ ID NO: 1058 - DNA, 16 bp, synthetic construct
  misc_feature 1..16: note = Synthetic oligonucleotide
  source 1..16: mol_type = other DNA
aaagtgcactcatcca

SEQ ID NO: 1059 - DNA, 16 bp, synthetic construct
  misc_feature 1..16: note = Synthetic oligonucleotide
  source 1..16: mol_type = other DNA
aggatctccagtatct

SEQ ID NO: 1060 - DNA, 16 bp, synthetic construct
  misc_feature 1..16: note = Synthetic oligonucleotide
  source 1..16: mol_type = other DNA
cttatgttatcctcaa

SEQ ID NO: 1061 - DNA, 16 bp, synthetic construct
  misc_feature 1..16: note = Synthetic oligonucleotide
  source 1..16: mol_type = other DNA
ttgtggaccttctgaa

SEQ ID NO: 1062 - DNA, 16 bp, synthetic construct
  misc_feature 1..16: note = Synthetic oligonucleotide
  source 1..16: mol_type = other DNA
atgccgacgagggtca

SEQ ID NO: 1063 - DNA, 16 bp, synthetic construct
  misc_feature 1..16: note = Synthetic oligonucleotide
  source 1..16: mol_type = other DNA
gattcccaactccatc

SEQ ID NO: 1064 - DNA, 16 bp, synthetic construct
  misc_feature 1..16: note = Synthetic oligonucleotide
  source 1..16: mol_type = other DNA
tagtccatggtactgc

SEQ ID NO: 1065 - DNA, 16 bp, synthetic construct
  misc_feature 1..16: note = Synthetic oligonucleotide
  source 1..16: mol_type = other DNA
aggcttttgatgacca

SEQ ID NO: 1066 - DNA, 16 bp, synthetic construct
  misc_feature 1..16: note = Synthetic oligonucleotide
  source 1..16: mol_type = other DNA
atgtccttcccaatgc

SEQ ID NO: 1067 - DNA, 16 bp, synthetic construct
  misc_feature 1..16: note = Synthetic oligonucleotide
  source 1..16: mol_type = other DNA
tgaggcatgcggtact

SEQ ID NO: 1068 - DNA, 16 bp, synthetic construct
  misc_feature 1..16: note = Synthetic oligonucleotide
  source 1..16: mol_type = other DNA
accctctccacctgtt

SEQ ID NO: 1069 - DNA, 16 bp, synthetic construct
  misc_feature 1..16: note = Synthetic oligonucleotide
  source 1..16: mol_type = other DNA
tagactacatccagca

SEQ ID NO: 1070 - DNA, 16 bp, synthetic construct
  misc_feature 1..16: note = Synthetic oligonucleotide
  source 1..16: mol_type = other DNA
gtccgcctgcagaatc

SEQ ID NO: 1071 - DNA, 16 bp, synthetic construct
  misc_feature 1..16: note = Synthetic oligonucleotide
  source 1..16: mol_type = other DNA
aaaagcgatggctcac

SEQ ID NO: 1072 - DNA, 16 bp, synthetic construct
  misc_feature 1..16: note = Synthetic oligonucleotide
  source 1..16: mol_type = other DNA
gctatggaaatgccaa

SEQ ID NO: 1073 - DNA, 16 bp, synthetic construct
  misc_feature 1..16: note = Synthetic oligonucleotide
  source 1..16: mol_type = other DNA
tccagttcccattttt

SEQ ID NO: 1074 - DNA, 16 bp, synthetic construct
  misc_feature 1..16: note = Synthetic oligonucleotide
  source 1..16: mol_type = other DNA
ctctctattcttccgt

SEQ ID NO: 1075 - DNA, 16 bp, synthetic construct
  misc_feature 1..16: note = Synthetic oligonucleotide
  source 1..16: mol_type = other DNA
ggaggacattgaacct

SEQ ID NO: 1076 - DNA, 16 bp, synthetic construct
  misc_feature 1..16: note = Synthetic oligonucleotide
  source 1..16: mol_type = other DNA
gccgctgcctgactga

SEQ ID NO: 1077 - DNA, 16 bp, synthetic construct
  misc_feature 1..16: note = Synthetic oligonucleotide
  source 1..16: mol_type = other DNA
cagtgttcaagcaggg

SEQ ID NO: 1078 - DNA, 16 bp, synthetic construct
  misc_feature 1..16: note = Synthetic oligonucleotide
  source 1..16: mol_type = other DNA
acttaccgggtaagag

SEQ ID NO: 1079 - DNA, 16 bp, synthetic construct
  misc_feature 1..16: note = Synthetic oligonucleotide
  source 1..16: mol_type = other DNA
ctgggcggcgacaaga

SEQ ID NO: 1080 - DNA, 16 bp, synthetic construct
  misc_feature 1..16: note = Synthetic oligonucleotide
  source 1..16: mol_type = other DNA
gaccaagcacagcaaa

SEQ ID NO: 1081 - DNA, 16 bp, synthetic construct
  misc_feature 1..16: note = Synthetic oligonucleotide
  source 1..16: mol_type = other DNA
caccattctgcaacgc

SEQ ID NO: 1082 - DNA, 16 bp, synthetic construct
  misc_feature 1..16: note = Synthetic oligonucleotide
  source 1..16: mol_type = other DNA
caatcagactcaagcc

SEQ ID NO: 1083 - DNA, 16 bp, synthetic construct
  misc_feature 1..16: note = Synthetic oligonucleotide
  source 1..16: mol_type = other DNA
cgtgaccacctgtctt

SEQ ID NO: 1084 - DNA, 16 bp, synthetic construct
  misc_feature 1..16: note = Synthetic oligonucleotide
  source 1..16: mol_type = other DNA
gagctggtgcctcgga

SEQ ID NO: 1085 - DNA, 16 bp, synthetic construct
  misc_feature 1..16: note = Synthetic oligonucleotide
  source 1..16: mol_type = other DNA
cctcattgcaaatcct

SEQ ID NO: 1086 - DNA, 16 bp, synthetic construct
  misc_feature 1..16: note = Synthetic oligonucleotide
  source 1..16: mol_type = other DNA
gctctgcaaatctctc

SEQ ID NO: 1087 - DNA, 16 bp, synthetic construct
  misc_feature 1..16: note = Synthetic oligonucleotide
  source 1..16: mol_type = other DNA
ccgtgtcaccctaagg

SEQ ID NO: 1088 - DNA, 16 bp, synthetic construct
  misc_feature 1..16: note = Synthetic oligonucleotide
  source 1..16: mol_type = other DNA
ccccgctgattccact

SEQ ID NO: 1089 - DNA, 16 bp, synthetic construct
  misc_feature 1..16: note = Synthetic oligonucleotide
  source 1..16: mol_type = other DNA
ctcaggtggaaacacc

SEQ ID NO: 1090 - DNA, 16 bp, synthetic construct
  misc_feature 1..16: note = Synthetic oligonucleotide
  source 1..16: mol_type = other DNA
gtccagttaagctgga

SEQ ID NO: 1091 - DNA, 16 bp, synthetic construct
  misc_feature 1..16: note = Synthetic oligonucleotide
  source 1..16: mol_type = other DNA
ccaggtagccgtgtta

SEQ ID NO: 1092 - DNA, 16 bp, synthetic construct
  misc_feature 1..16: note = Synthetic oligonucleotide
  source 1..16: mol_type = other DNA
atgactgaactcagcc

SEQ ID NO: 1093 - DNA, 16 bp, synthetic construct
  misc_feature 1..16: note = Synthetic oligonucleotide
  source 1..16: mol_type = other DNA
cctccagtttgctgtt

SEQ ID NO: 1094 - DNA, 16 bp, synthetic construct
  misc_feature 1..16: note = Synthetic oligonucleotide
  source 1..16: mol_type = other DNA
aaaccttgtctccgac

SEQ ID NO: 1095 - DNA, 16 bp, synthetic construct
  misc_feature 1..16: note = Synthetic oligonucleotide
  source 1..16: mol_type = other DNA
tttgtaagtgcaacca

SEQ ID NO: 1096 - DNA, 16 bp, synthetic construct
  misc_feature 1..16: note = Synthetic oligonucleotide
  source 1..16: mol_type = other DNA
agacctccctaaactc

SEQ ID NO: 1097 - DNA, 16 bp, synthetic construct
  misc_feature 1..16: note = Synthetic oligonucleotide
  source 1..16: mol_type = other DNA
caaggctaagttccgg

SEQ ID NO: 1098 - DNA, 16 bp, synthetic construct
  misc_feature 1..16: note = Synthetic oligonucleotide
  source 1..16: mol_type = other DNA
aagacaagaaccccaa

SEQ ID NO: 1099 - DNA, 16 bp, synthetic construct
  misc_feature 1..16: note = Synthetic oligonucleotide
  source 1..16: mol_type = other DNA
caaaactgcattgccc

SEQ ID NO: 1100 - DNA, 16 bp, synthetic construct
  misc_feature 1..16: note = Synthetic oligonucleotide
  source 1..16: mol_type = other DNA
acccacccgcaccaca

SEQ ID NO: 1101 - DNA, 16 bp, synthetic construct
  misc_feature 1..16: note = Synthetic oligonucleotide
  source 1..16: mol_type = other DNA
gagatccaactcggcg

SEQ ID NO: 1102 - DNA, 16 bp, synthetic construct
  misc_feature 1..16: note = Synthetic oligonucleotide
  source 1..16: mol_type = other DNA
gcccacaggatcctga

SEQ ID NO: 1103 - DNA, 16 bp, synthetic construct
  misc_feature 1..16: note = Synthetic oligonucleotide
  source 1..16: mol_type = other DNA
aaccccctgaaactgc

SEQ ID NO: 1104 - DNA, 16 bp, synthetic construct
  misc_feature 1..16: note = Synthetic oligonucleotide
  source 1..16: mol_type = other DNA
ttcctggacaggcaat

SEQ ID NO: 1105 - DNA, 16 bp, synthetic construct
  misc_feature 1..16: note = Synthetic oligonucleotide
  source 1..16: mol_type = other DNA
caggtttggatggaag

SEQ ID NO: 1106 - DNA, 16 bp, synthetic construct
  misc_feature 1..16: note = Synthetic oligonucleotide
  source 1..16: mol_type = other DNA
ggaaatgaacgcaatg

SEQ ID NO: 1107 - DNA, 16 bp, synthetic construct
  misc_feature 1..16: note = Synthetic oligonucleotide
  source 1..16: mol_type = other DNA
tgagtgctctcggctt

SEQ ID NO: 1108 - DNA, 16 bp, synthetic construct
  misc_feature 1..16: note = Synthetic oligonucleotide
  source 1..16: mol_type = other DNA
gtacacggctctccac

SEQ ID NO: 1109 - DNA, 16 bp, synthetic construct
  misc_feature 1..16: note = Synthetic oligonucleotide
  source 1..16: mol_type = other DNA
cttgggcactctcaga

SEQ ID NO: 1110 - DNA, 16 bp, synthetic construct
  misc_feature 1..16: note = Synthetic oligonucleotide
  source 1..16: mol_type = other DNA
aaactccacagcattg

SEQ ID NO: 1111 - DNA, 16 bp, synthetic construct
  misc_feature 1..16: note = Synthetic oligonucleotide
  source 1..16: mol_type = other DNA
cgcccaaaaccatcaa

SEQ ID NO: 1112 - DNA, 16 bp, synthetic construct
  misc_feature 1..16: note = Synthetic oligonucleotide
  source 1..16: mol_type = other DNA
acacacaagagacctc

SEQ ID NO: 1113 - DNA, 16 bp, synthetic construct
  misc_feature 1..16: note = Synthetic oligonucleotide
  source 1..16: mol_type = other DNA
ttatggaattgcagat

SEQ ID NO: 1114 - DNA, 16 bp, synthetic construct
  misc_feature 1..16: note = Synthetic oligonucleotide
  source 1..16: mol_type = other DNA
tcaagtcagtacagag

SEQ ID NO: 1115 - DNA, 16 bp, synthetic construct
  misc_feature 1..16: note = Synthetic oligonucleotide
  source 1..16: mol_type = other DNA
cacccacacatgtttc

SEQ ID NO: 1116 - DNA, 16 bp, synthetic construct
  misc_feature 1..16: note = Synthetic oligonucleotide
  source 1..16: mol_type = other DNA
cagaatttccactatt

SEQ ID NO: 1117 - DNA, 16 bp, synthetic construct
  misc_feature 1..16: note = Synthetic oligonucleotide
  source 1..16: mol_type = other DNA
ttggttcaaaagcagc

SEQ ID NO: 1118 - DNA, 16 bp, synthetic construct
  misc_feature 1..16: note = Synthetic oligonucleotide
  source 1..16: mol_type = other DNA
ttgggtcaaacacttt

SEQ ID NO: 1119 - DNA, 16 bp, synthetic construct
  misc_feature 1..16: note = Synthetic oligonucleotide
  source 1..16: mol_type = other DNA
catgaagtgagccttc

SEQ ID NO: 1120 - DNA, 16 bp, synthetic construct
  misc_feature 1..16: note = Synthetic oligonucleotide
  source 1..16: mol_type = other DNA
gccagatgttgaagtc

SEQ ID NO: 1121 - DNA, 16 bp, synthetic construct
  misc_feature 1..16: note = Synthetic oligonucleotide
  source 1..16: mol_type = other DNA
gtcctattgtaagaac

SEQ ID NO: 1122 - DNA, 16 bp, synthetic construct
  misc_feature 1..16: note = Synthetic oligonucleotide
  source 1..16: mol_type = other DNA
actcaggtgactacat

SEQ ID NO: 1123 - DNA, 16 bp, synthetic construct
  misc_feature 1..16: note = Synthetic oligonucleotide
  source 1..16: mol_type = other DNA
gagtcattagtgctat

SEQ ID NO: 1124 - DNA, 16 bp, synthetic construct
  misc_feature 1..16: note = Synthetic oligonucleotide
  source 1..16: mol_type = other DNA
cagccattgcataaga

SEQ ID NO: 1125 - DNA, 16 bp, synthetic construct
  misc_feature 1..16: note = Synthetic oligonucleotide
  source 1..16: mol_type = other DNA
ataccgaggaattcga

SEQ ID NO: 1126 - DNA, 16 bp, synthetic construct
  misc_feature 1..16: note = Synthetic oligonucleotide
  source 1..16: mol_type = other DNA
ccacctccagttatgc

SEQ ID NO: 1127 - DNA, 16 bp, synthetic construct
  misc_feature 1..16: note = Synthetic oligonucleotide
  source 1..16: mol_type = other DNA
aaaagtgcactcatcc

SEQ ID NO: 1128 - DNA, 16 bp, synthetic construct
  misc_feature 1..16: note = Synthetic oligonucleotide
  source 1..16: mol_type = other DNA
gaggatctccagtatc

SEQ ID NO: 1129 - DNA, 16 bp, synthetic construct
  misc_feature 1..16: note = Synthetic oligonucleotide
  source 1..16: mol_type = other DNA
cttcttatgttatcct

SEQ ID NO: 1130 - DNA, 16 bp, synthetic construct
  misc_feature 1..16: note = Synthetic oligonucleotide
  source 1..16: mol_type = other DNA
tttgtggaccttctga

SEQ ID NO: 1131 - DNA, 16 bp, synthetic construct
  misc_feature 1..16: note = Synthetic oligonucleotide
  source 1..16: mol_type = other DNA
catgccgacgagggtc

SEQ ID NO: 1132 - DNA, 16 bp, synthetic construct
  misc_feature 1..16: note = Synthetic oligonucleotide
  source 1..16: mol_type = other DNA
ctgtgattcccaactc

SEQ ID NO: 1133 - DNA, 16 bp, synthetic construct
  misc_feature 1..16: note = Synthetic oligonucleotide
  source 1..16: mol_type = other DNA
gtagtccatggtactg

SEQ ID NO: 1134 - DNA, 16 bp, synthetic construct
  misc_feature 1..16: note = Synthetic oligonucleotide
  source 1..16: mol_type = other DNA
aaggcttttgatgacc

SEQ ID NO: 1135 - DNA, 16 bp, synthetic construct
  misc_feature 1..16: note = Synthetic oligonucleotide
  source 1..16: mol_type = other DNA
gatgtccttcccaatg

SEQ ID NO: 1136 - DNA, 16 bp, synthetic construct
  misc_feature 1..16: note = Synthetic oligonucleotide
  source 1..16: mol_type = other DNA
ctgaggcatgcggtac

SEQ ID NO: 1137 - DNA, 16 bp, synthetic construct
  misc_feature 1..16: note = Synthetic oligonucleotide
  source 1..16: mol_type = other DNA
aaccctctccacctgt

SEQ ID NO: 1138 - DNA, 16 bp, synthetic construct
  misc_feature 1..16: note = Synthetic oligonucleotide
  source 1..16: mol_type = other DNA
gtagactacatccagc

SEQ ID NO: 1139 - DNA, 16 bp, synthetic construct
  misc_feature 1..16: note = Synthetic oligonucleotide
  source 1..16: mol_type = other DNA
ggtccgcctgcagaat

SEQ ID NO: 1140 - DNA, 16 bp, synthetic construct
  misc_feature 1..16: note = Synthetic oligonucleotide
  source 1..16: mol_type = other DNA
gggtcaaaagcgatgg

SEQ ID NO: 1141 - DNA, 16 bp, synthetic construct
  misc_feature 1..16: note = Synthetic oligonucleotide
  source 1..16: mol_type = other DNA
agctatggaaatgcca

SEQ ID NO: 1142 - DNA, 16 bp, synthetic construct
  misc_feature 1..16: note = Synthetic oligonucleotide
  source 1..16: mol_type = other DNA
tctccagttcccattt

SEQ ID NO: 1143 - DNA, 16 bp, synthetic construct
  misc_feature 1..16: note = Synthetic oligonucleotide
  source 1..16: mol_type = other DNA
agcctcctctctattc

SEQ ID NO: 1144 - DNA, 16 bp, synthetic construct
  misc_feature 1..16: note = Synthetic oligonucleotide
  source 1..16: mol_type = other DNA
cggaggacattgaacc

SEQ ID NO: 1145 - DNA, 16 bp, synthetic construct
  misc_feature 1..16: note = Synthetic oligonucleotide
  source 1..16: mol_type = other DNA
agccgctgcctgactg

SEQ ID NO: 1146 - DNA, 16 bp, synthetic construct
  misc_feature 1..16: note = Synthetic oligonucleotide
  source 1..16: mol_type = other DNA
tcagtgttcaagcagg

SEQ ID NO: 1147 - DNA, 16 bp, synthetic construct
  misc_feature 1..16: note = Synthetic oligonucleotide
  source 1..16: mol_type = other DNA
tacttaccgggtaaga

SEQ ID NO: 1148 - DNA, 16 bp, synthetic construct
  misc_feature 1..16: note = Synthetic oligonucleotide
  source 1..16: mol_type = other DNA
cctgggcggcgacaag

SEQ ID NO: 1149 - DNA, 16 bp, synthetic construct
  misc_feature 1..16: note = Synthetic oligonucleotide
  source 1..16: mol_type = other DNA
tgaccaagcacagcaa

SEQ ID NO: 1150 - DNA, 16 bp, synthetic construct
  misc_feature 1..16: note = Synthetic oligonucleotide
  source 1..16: mol_type = other DNA
gcaccattctgcaacg

SEQ ID NO: 1151 - DNA, 16 bp, synthetic construct
  misc_feature 1..16: note = Synthetic oligonucleotide
  source 1..16: mol_type = other DNA
tctatagtttaagagc

SEQ ID NO: 1152 - DNA, 16 bp, synthetic construct
  misc_feature 1..16: note = Synthetic oligonucleotide
  source 1..16: mol_type = other DNA
tcccgcctcagggctc

SEQ ID NO: 1153 - DNA, 16 bp, synthetic construct
  misc_feature 1..16: note = Synthetic oligonucleotide
  source 1..16: mol_type = other DNA
acaccatctcatgagc

SEQ ID NO: 1154 - DNA, 16 bp, synthetic construct
  misc_feature 1..16: note = Synthetic oligonucleotide
  source 1..16: mol_type = other DNA
gtttttacaatagtgc

SEQ ID NO: 1155 - DNA, 16 bp, synthetic construct
  misc_feature 1..16: note = Synthetic oligonucleotide
  source 1..16: mol_type = other DNA
gcttgcttgagcagcc

SEQ ID NO: 1156 - DNA, 16 bp, synthetic construct
  misc_feature 1..16: note = Synthetic oligonucleotide
  source 1..16: mol_type = other DNA
gccgtgtcaccctaag

SEQ ID NO: 1157 - DNA, 16 bp, synthetic construct
  misc_feature 1..16: note = Synthetic oligonucleotide
  source 1..16: mol_type = other DNA
cccccgctgattccac

SEQ ID NO: 1158 - DNA, 16 bp, synthetic construct
  misc_feature 1..16: note = Synthetic oligonucleotide
  source 1..16: mol_type = other DNA
cctcaggtggaaacac

SEQ ID NO: 1159 - DNA, 16 bp, synthetic construct
  misc_feature 1..16: note = Synthetic oligonucleotide
  source 1..16: mol_type = other DNA
ggtccagttaagctgg

SEQ ID NO: 1160 - DNA, 16 bp, synthetic construct
  misc_feature 1..16: note = Synthetic oligonucleotide
  source 1..16: mol_type = other DNA
gccaggtagccgtgtt

SEQ ID NO: 1161 - DNA, 16 bp, synthetic construct
  misc_feature 1..16: note = Synthetic oligonucleotide
  source 1..16: mol_type = other DNA
gatgactgaactcagc

SEQ ID NO: 1162 - DNA, 16 bp, synthetic construct
  misc_feature 1..16: note = Synthetic oligonucleotide
  source 1..16: mol_type = other DNA
cctcctccagtttgct

SEQ ID NO: 1163 - DNA, 16 bp, synthetic construct
  misc_feature 1..16: note = Synthetic oligonucleotide
  source 1..16: mol_type = other DNA
taaaccttgtctccga

SEQ ID NO: 1164 - DNA, 16 bp, synthetic construct
  misc_feature 1..16: note = Synthetic oligonucleotide
  source 1..16: mol_type = other DNA
ttttgtaagtgcaacc

SEQ ID NO: 1165 - DNA, 16 bp, synthetic construct
  misc_feature 1..16: note = Synthetic oligonucleotide
  source 1..16: mol_type = other DNA
gagacctccctaaact

SEQ ID NO: 1166 - DNA, 16 bp, synthetic construct
  misc_feature 1..16: note = Synthetic oligonucleotide
  source 1..16: mol_type = other DNA
gcaaggctaagttccg

SEQ ID NO: 1167 - DNA, 16 bp, synthetic construct
  misc_feature 1..16: note = Synthetic oligonucleotide
  source 1..16: mol_type = other DNA
caaagacaagaacccc

SEQ ID NO: 1168 - DNA, 16 bp, synthetic construct
  misc_feature 1..16: note = Synthetic oligonucleotide
  source 1..16: mol_type = other DNA
acaaaactgcattgcc

SEQ ID NO: 1169 - DNA, 16 bp, synthetic construct
  misc_feature 1..16: note = Synthetic oligonucleotide
  source 1..16: mol_type = other DNA
actaaaccccacaccc

SEQ ID NO: 1170 - DNA, 16 bp, synthetic construct
  misc_feature 1..16: note = Synthetic oligonucleotide
  source 1..16: mol_type = other DNA
tgagatccaactcggc

SEQ ID NO: 1171 - DNA, 16 bp, synthetic construct
  misc_feature 1..16: note = Synthetic oligonucleotide
  source 1..16: mol_type = other DNA
ggcccacaggatcctg

SEQ ID NO: 1172 - DNA, 16 bp, synthetic construct
  misc_feature 1..16: note = Synthetic oligonucleotide
  source 1..16: mol_type = other DNA
cttctgttagatacaa

SEQ ID NO: 1173 - DNA, 16 bp, synthetic construct
  misc_feature 1..16: note = Synthetic oligonucleotide
  source 1..16: mol_type = other DNA
taaccccctgaaactg

SEQ ID NO: 1174 - DNA, 16 bp, synthetic construct
  misc_feature 1..16: note = Synthetic oligonucleotide
  source 1..16: mol_type = other DNA
attcctggacaggcaa

SEQ ID NO: 1175 - DNA, 16 bp, synthetic construct
  misc_feature 1..16: note = Synthetic oligonucleotide
  source 1..16: mol_type = other DNA
ccaggtttggatggaa

SEQ ID NO: 1176 - DNA, 16 bp, synthetic construct
  misc_feature 1..16: note = Synthetic oligonucleotide
  source 1..16: mol_type = other DNA
gggaaatgaacgcaat

SEQ ID NO: 1177 - DNA, 16 bp, synthetic construct
  misc_feature 1..16: note = Synthetic oligonucleotide
  source 1..16: mol_type = other DNA
ctgagtgctctcggct

SEQ ID NO: 1178 - DNA, 16 bp, synthetic construct
  misc_feature 1..16: note = Synthetic oligonucleotide
  source 1..16: mol_type = other DNA
ggtacacggctctcca

SEQ ID NO: 1179 - DNA, 16 bp, synthetic construct
  misc_feature 1..16: note = Synthetic oligonucleotide
  source 1..16: mol_type = other DNA
tcttgggcactctcag

SEQ ID NO: 1180 - DNA, 16 bp, synthetic construct
  misc_feature 1..16: note = Synthetic oligonucleotide
  source 1..16: mol_type = other DNA
atgtctcaaactccac

SEQ ID NO: 1181 - DNA, 16 bp, synthetic construct
  misc_feature 1..16: note = Synthetic oligonucleotide
  source 1..16: mol_type = other DNA
ccgcccaaaaccatca

SEQ ID NO: 1182 - DNA, 16 bp, synthetic construct
  misc_feature 1..16: note = Synthetic oligonucleotide
  source 1..16: mol_type = other DNA
gcacacacaagagacc

SEQ ID NO: 1183 - DNA, 16 bp, synthetic construct
  misc_feature 1..16: note = Synthetic oligonucleotide
  source 1..16: mol_type = other DNA
gaattatggaattgca

SEQ ID NO: 1184 - DNA, 16 bp, synthetic construct
  misc_feature 1..16: note = Synthetic oligonucleotide
  source 1..16: mol_type = other DNA
actcaagtcagtacag

SEQ ID NO: 1185 - DNA, 16 bp, synthetic construct
  misc_feature 1..16: note = Synthetic oligonucleotide
  source 1..16: mol_type = other DNA
gtaatcacacccacac

SEQ ID NO: 1186 - DNA, 16 bp, synthetic construct
  misc_feature 1..16: note = Synthetic oligonucleotide
  source 1..16: mol_type = other DNA
ttcagaatttccacta

SEQ ID NO: 1187 - DNA, 16 bp, synthetic construct
  misc_feature 1..16: note = Synthetic oligonucleotide
  source 1..16: mol_type = other DNA
attggttcaaaagcag

SEQ ID NO: 1188 - DNA, 16 bp, synthetic construct
  misc_feature 1..16: note = Synthetic oligonucleotide
  source 1..16: mol_type = other DNA
gttgggtcaaacactt

SEQ ID NO: 1189 - DNA, 16 bp, synthetic construct
  misc_feature 1..16: note = Synthetic oligonucleotide
  source 1..16: mol_type = other DNA
acatgaagtgagcctt

SEQ ID NO: 1190 - DNA, 16 bp, synthetic construct
  misc_feature 1..16: note = Synthetic oligonucleotide
  source 1..16: mol_type = other DNA
tttggcaccttcacct

SEQ ID NO: 1191 - DNA, 16 bp, synthetic construct
  misc_feature 1..16: note = Synthetic oligonucleotide
  source 1..16: mol_type = other DNA
ttagagggctagtgtc

SEQ ID NO: 1192 - DNA, 16 bp, synthetic construct
  misc_feature 1..16: note = Synthetic oligonucleotide
  source 1..16: mol_type = other DNA
aactcaggtgactaca

SEQ ID NO: 1193 - DNA, 16 bp, synthetic construct
  misc_feature 1..16: note = Synthetic oligonucleotide
  source 1..16: mol_type = other DNA
ggagtcattagtgcta

SEQ ID NO: 1194 - DNA, 16 bp, synthetic construct
  misc_feature 1..16: note = Synthetic oligonucleotide
  source 1..16: mol_type = other DNA
acagccattgcataag

SEQ ID NO: 1195 - DNA, 16 bp, synthetic construct
  misc_feature 1..16: note = Synthetic oligonucleotide
  source 1..16: mol_type = other DNA
tataccgaggaattcg

SEQ ID NO: 1196 - DNA, 16 bp, synthetic construct
  misc_feature 1..16: note = Synthetic oligonucleotide
  source 1..16: mol_type = other DNA
cccacctccagttatg

SEQ ID NO: 1197 - DNA, 16 bp, synthetic construct
  misc_feature 1..16: note = Synthetic oligonucleotide
  source 1..16: mol_type = other DNA
caaggaaaagtgcact

SEQ ID NO: 1198 - DNA, 16 bp, synthetic construct
  misc_feature 1..16: note = Synthetic oligonucleotide
  source 1..16: mol_type = other DNA
tgaggatctccagtat

SEQ ID NO: 1199 - DNA, 16 bp, synthetic construct
  misc_feature 1..16: note = Synthetic oligonucleotide
  source 1..16: mol_type = other DNA
ttcatgatcatttgtc

SEQ ID NO: 1200 - DNA, 16 bp, synthetic construct
  misc_feature 1..16: note = Synthetic oligonucleotide
  source 1..16: mol_type = other DNA
ccttcttatgttatcc

SEQ ID NO: 1201 - DNA, 16 bp, synthetic construct
  misc_feature 1..16: note = Synthetic oligonucleotide
  source 1..16: mol_type = other DNA
ctttgtggaccttctg

SEQ ID NO: 1202 - DNA, 16 bp, synthetic construct
  misc_feature 1..16: note = Synthetic oligonucleotide
  source 1..16: mol_type = other DNA
ccatgccgacgagggt

SEQ ID NO: 1203 - DNA, 16 bp, synthetic construct
  misc_feature 1..16: note = Synthetic oligonucleotide
  source 1..16: mol_type = other DNA
gctgtgattcccaact

SEQ ID NO: 1204 - DNA, 16 bp, synthetic construct
  misc_feature 1..16: note = Synthetic oligonucleotide
  source 1..16: mol_type = other DNA
cgtagtccatggtact

SEQ ID NO: 1205 - DNA, 16 bp, synthetic construct
  misc_feature 1..16: note = Synthetic oligonucleotide
  source 1..16: mol_type = other DNA
caaggcttttgatgac

SEQ ID NO: 1206 - DNA, 16 bp, synthetic construct
  misc_feature 1..16: note = Synthetic oligonucleotide
  source 1..16: mol_type = other DNA
ggatgtccttcccaat

SEQ ID NO: 1207 - DNA, 16 bp, synthetic construct
  misc_feature 1..16: note = Synthetic oligonucleotide
  source 1..16: mol_type = other DNA
ggctcagtgacccggg

SEQ ID NO: 1208 - DNA, 16 bp, synthetic construct
  misc_feature 1..16: note = Synthetic oligonucleotide
  source 1..16: mol_type = other DNA
attaaccctctccacc

SEQ ID NO: 1209 - DNA, 16 bp, synthetic construct
  misc_feature 1..16: note = Synthetic oligonucleotide
  source 1..16: mol_type = other DNA
ggtagactacatccag

SEQ ID NO: 1210 - DNA, 16 bp, synthetic construct
  misc_feature 1..16: note = Synthetic oligonucleotide
  source 1..16: mol_type = other DNA
tggtccgcctgcagaa

SEQ ID NO: 1211 - DNA, 16 bp, synthetic construct
  misc_feature 1..16: note = Synthetic oligonucleotide
  source 1..16: mol_type = other DNA
cagctatggaaatgcc

SEQ ID NO: 1212 - DNA, 16 bp, synthetic construct
  misc_feature 1..16: note = Synthetic oligonucleotide
  source 1..16: mol_type = other DNA
actctccagttcccat

SEQ ID NO: 1213 - DNA, 16 bp, synthetic construct
  misc_feature 1..16: note = Synthetic oligonucleotide
  source 1..16: mol_type = other DNA
caagcctcctctctat

SEQ ID NO: 1214 - DNA, 16 bp, synthetic construct
  misc_feature 1..16: note = Synthetic oligonucleotide
  source 1..16: mol_type = other DNA
ttcggaggacattgaa

SEQ ID NO: 1215 - DNA, 16 bp, synthetic construct
  misc_feature 1..16: note = Synthetic oligonucleotide
  source 1..16: mol_type = other DNA
aagccgctgcctgact

SEQ ID NO: 1216 - DNA, 16 bp, synthetic construct
  misc_feature 1..16: note = Synthetic oligonucleotide
  source 1..16: mol_type = other DNA
ttcagtgttcaagcag

SEQ ID NO: 1217 - DNA, 16 bp, synthetic construct
  misc_feature 1..16: note = Synthetic oligonucleotide
  source 1..16: mol_type = other DNA
tcctgggcggcgacaa

SEQ ID NO: 1218 - DNA, 16 bp, synthetic construct
  misc_feature 1..16: note = Synthetic oligonucleotide
  source 1..16: mol_type = other DNA
ggcaccattctgcaac

SEQ ID NO: 1219 - DNA, 16 bp, synthetic construct
  misc_feature 1..16: note = Synthetic oligonucleotide
  source 1..16: mol_type = other DNA
caaccctctatagttt

SEQ ID NO: 1220 - DNA, 16 bp, synthetic construct
  misc_feature 1..16: note = Synthetic oligonucleotide
  source 1..16: mol_type = other DNA
ggagccctccctcccg

SEQ ID NO: 1221 - DNA, 16 bp, synthetic construct
  misc_feature 1..16: note = Synthetic oligonucleotide
  source 1..16: mol_type = other DNA
tgtgtgatcccctagg

SEQ ID NO: 1222 - DNA, 16 bp, synthetic construct
  misc_feature 1..16: note = Synthetic oligonucleotide
  source 1..16: mol_type = other DNA
gccagtgtttttacaa

SEQ ID NO: 1223 - DNA, 16 bp, synthetic construct
  misc_feature 1..16: note = Synthetic oligonucleotide
  source 1..16: mol_type = other DNA
tgagccaccagtggac

SEQ ID NO: 1224 - DNA, 16 bp, synthetic construct
  misc_feature 1..16: note = Synthetic oligonucleotide
  source 1..16: mol_type = other DNA
ccccccgctgattcca

SEQ ID NO: 1225 - DNA, 16 bp, synthetic construct
  misc_feature 1..16: note = Synthetic oligonucleotide
  source 1..16: mol_type = other DNA
agcctcaggtggaaac

SEQ ID NO: 1226 - DNA, 16 bp, synthetic construct
  misc_feature 1..16: note = Synthetic oligonucleotide
  source 1..16: mol_type = other DNA
gggtccagttaagctg

SEQ ID NO: 1227 - DNA, 16 bp, synthetic construct
  misc_feature 1..16: note = Synthetic oligonucleotide
  source 1..16: mol_type = other DNA
tagatgactgaactca

SEQ ID NO: 1228 - DNA, 16 bp, synthetic construct
  misc_feature 1..16: note = Synthetic oligonucleotide
  source 1..16: mol_type = other DNA
gcctcctccagtttgc

SEQ ID NO: 1229 - DNA, 16 bp, synthetic construct
  misc_feature 1..16: note = Synthetic oligonucleotide
  source 1..16: mol_type = other DNA
gataaaccttgtctcc

SEQ ID NO: 1230 - DNA, 16 bp, synthetic construct
  misc_feature 1..16: note = Synthetic oligonucleotide
  source 1..16: mol_type = other DNA
gttttgtaagtgcaac

SEQ ID NO: 1231 - DNA, 16 bp, synthetic construct
  misc_feature 1..16: note = Synthetic oligonucleotide
  source 1..16: mol_type = other DNA
ggagacctccctaaac

SEQ ID NO: 1232 - DNA, 16 bp, synthetic construct
  misc_feature 1..16: note = Synthetic oligonucleotide
  source 1..16: mol_type = other DNA
ggcaaggctaagttcc

SEQ ID NO: 1233 - DNA, 16 bp, synthetic construct
  misc_feature 1..16: note = Synthetic oligonucleotide
  source 1..16: mol_type = other DNA
cagcaaagacaagaac

SEQ ID NO: 1234 - DNA, 16 bp, synthetic construct
  misc_feature 1..16: note = Synthetic oligonucleotide
  source 1..16: mol_type = other DNA
gtacaaaactgcattg

SEQ ID NO: 1235 - DNA, 16 bp, synthetic construct
  misc_feature 1..16: note = Synthetic oligonucleotide
  source 1..16: mol_type = other DNA
cactaaaccccacacc

SEQ ID NO: 1236 - DNA, 16 bp, synthetic construct
  misc_feature 1..16: note = Synthetic oligonucleotide
  source 1..16: mol_type = other DNA
gtgagatccaactcgg

SEQ ID NO: 1237 - DNA, 16 bp, synthetic construct
  misc_feature 1..16: note = Synthetic oligonucleotide
  source 1..16: mol_type = other DNA
tgggcccacaggatcc

SEQ ID NO: 1238 - DNA, 16 bp, synthetic construct
  misc_feature 1..16: note = Synthetic oligonucleotide
  source 1..16: mol_type = other DNA
acttctgttagataca

SEQ ID NO: 1239 - DNA, 16 bp, synthetic construct
  misc_feature 1..16: note = Synthetic oligonucleotide
  source 1..16: mol_type = other DNA
gtaaccccctgaaact

SEQ ID NO: 1240 - DNA, 16 bp, synthetic construct
  misc_feature 1..16: note = Synthetic oligonucleotide
  source 1..16: mol_type = other DNA
aacattcctggacagg

SEQ ID NO: 1241 - DNA, 16 bp, synthetic construct
  misc_feature 1..16: note = Synthetic oligonucleotide
  source 1..16: mol_type = other DNA
cccaggtttggatgga

SEQ ID NO: 1242 - DNA, 16 bp, synthetic construct
  misc_feature 1..16: note = Synthetic oligonucleotide
  source 1..16: mol_type = other DNA
agggaaatgaacgcaa

SEQ ID NO: 1243 - DNA, 16 bp, synthetic construct
  misc_feature 1..16: note = Synthetic oligonucleotide
  source 1..16: mol_type = other DNA
gctgagtgctctcggc

SEQ ID NO: 1244 - DNA, 16 bp, synthetic construct
  misc_feature 1..16: note = Synthetic oligonucleotide
  source 1..16: mol_type = other DNA
gggtacacggctctcc

SEQ ID NO: 1245 - DNA, 16 bp, synthetic construct
  misc_feature 1..16: note = Synthetic oligonucleotide
  source 1..16: mol_type = other DNA
gtcttgggcactctca

SEQ ID NO: 1246 - DNA, 16 bp, synthetic construct
  misc_feature 1..16: note = Synthetic oligonucleotide
  source 1..16: mol_type = other DNA
taatgtctcaaactcc

SEQ ID NO: 1247 - DNA, 16 bp, synthetic construct
  misc_feature 1..16: note = Synthetic oligonucleotide
  source 1..16: mol_type = other DNA
accgcccaaaaccatc

SEQ ID NO: 1248 - DNA, 16 bp, synthetic construct
  misc_feature 1..16: note = Synthetic oligonucleotide
  source 1..16: mol_type = other DNA
tgcacacacaagagac

SEQ ID NO: 1249 - DNA, 16 bp, synthetic construct
  misc_feature 1..16: note = Synthetic oligonucleotide
  source 1..16: mol_type = other DNA
ggaattatggaattgc

SEQ ID NO: 1250 - DNA, 16 bp, synthetic construct
  misc_feature 1..16: note = Synthetic oligonucleotide
  source 1..16: mol_type = other DNA
aactcaagtcagtaca

SEQ ID NO: 1251 - DNA, 16 bp, synthetic construct
  misc_feature 1..16: note = Synthetic oligonucleotide
  source 1..16: mol_type = other DNA
ccctgtaatcacaccc

SEQ ID NO: 1252 - DNA, 16 bp, synthetic construct
  misc_feature 1..16: note = Synthetic oligonucleotide
  source 1..16: mol_type = other DNA
tattggttcaaaagca

SEQ ID NO: 1253 - DNA, 16 bp, synthetic construct
  misc_feature 1..16: note = Synthetic oligonucleotide
  source 1..16: mol_type = other DNA
ctgttgggtcaaacac

SEQ ID NO: 1254 - DNA, 16 bp, synthetic construct
  misc_feature 1..16: note = Synthetic oligonucleotide
  source 1..16: mol_type = other DNA
aacatgaagtgagcct

SEQ ID NO: 1255 - DNA, 16 bp, synthetic construct
  misc_feature 1..16: note = Synthetic oligonucleotide
  source 1..16: mol_type = other DNA
ttttggcaccttcacc

SEQ ID NO: 1256 - DNA, 16 bp, synthetic construct
  misc_feature 1..16: note = Synthetic oligonucleotide
  source 1..16: mol_type = other DNA
attagagggctagtgt

SEQ ID NO: 1257 - DNA, 16 bp, synthetic construct
  misc_feature 1..16: note = Synthetic oligonucleotide
  source 1..16: mol_type = other DNA
aaactcaggtgactac

SEQ ID NO: 1258 - DNA, 16 bp, synthetic construct
  misc_feature 1..16: note = Synthetic oligonucleotide
  source 1..16: mol_type = other DNA
tggagtcattagtgct

SEQ ID NO: 1259 - DNA, 16 bp, synthetic construct
  misc_feature 1..16: note = Synthetic oligonucleotide
  source 1..16: mol_type = other DNA
aacagccattgcataa

SEQ ID NO: 1260 - DNA, 16 bp, synthetic construct
  misc_feature 1..16: note = Synthetic oligonucleotide
  source 1..16: mol_type = other DNA
caagatataccgagga

SEQ ID NO: 1261 - DNA, 16 bp, synthetic construct
  misc_feature 1..16: note = Synthetic oligonucleotide
  source 1..16: mol_type = other DNA
ttcccctggcagagac

SEQ ID NO: 1262 - DNA, 16 bp, synthetic construct
  misc_feature 1..16: note = Synthetic oligonucleotide
  source 1..16: mol_type = other DNA
ccctcgctccagcttc

SEQ ID NO: 1263 - DNA, 16 bp, synthetic construct
  misc_feature 1..16: note = Synthetic oligonucleotide
  source 1..16: mol_type = other DNA
cttactttgaggatct

SEQ ID NO: 1264 - DNA, 16 bp, synthetic construct
  misc_feature 1..16: note = Synthetic oligonucleotide
  source 1..16: mol_type = other DNA
tactgctggcctttat

SEQ ID NO: 1265 - DNA, 16 bp, synthetic construct
  misc_feature 1..16: note = Synthetic oligonucleotide
  source 1..16: mol_type = other DNA
cggagccttcttatgt

SEQ ID NO: 1266 - DNA, 16 bp, synthetic construct
  misc_feature 1..16: note = Synthetic oligonucleotide
  source 1..16: mol_type = other DNA
tggtgcctttgtggac

SEQ ID NO: 1267 - DNA, 16 bp, synthetic construct
  misc_feature 1..16: note = Synthetic oligonucleotide
  source 1..16: mol_type = other DNA
cagacccatgccgacg

SEQ ID NO: 1268 - DNA, 16 bp, synthetic construct
  misc_feature 1..16: note = Synthetic oligonucleotide
  source 1..16: mol_type = other DNA
aagcggctgtgattcc

SEQ ID NO: 1269 - DNA, 16 bp, synthetic construct
  misc_feature 1..16: note = Synthetic oligonucleotide
  source 1..16: mol_type = other DNA
tctttccgtagtccat

SEQ ID NO: 1270 - DNA, 16 bp, synthetic construct
  misc_feature 1..16: note = Synthetic oligonucleotide
  source 1..16: mol_type = other DNA
cacccaaaaactccct

SEQ ID NO: 1271 - DNA, 16 bp, synthetic construct
  misc_feature 1..16: note = Synthetic oligonucleotide
  source 1..16: mol_type = other DNA
ggcacggatgtccttc

SEQ ID NO: 1272 - DNA, 16 bp, synthetic construct
  misc_feature 1..16: note = Synthetic oligonucleotide
  source 1..16: mol_type = other DNA
agattggctcagtgac

SEQ ID NO: 1273 - DNA, 16 bp, synthetic construct
  misc_feature 1..16: note = Synthetic oligonucleotide
  source 1..16: mol_type = other DNA
ctgggttcattaaccc

SEQ ID NO: 1274 - DNA, 16 bp, synthetic construct
  misc_feature 1..16: note = Synthetic oligonucleotide
  source 1..16: mol_type = other DNA
cacgaggtagactaca

SEQ ID NO: 1275 - DNA, 16 bp, synthetic construct
  misc_feature 1..16: note = Synthetic oligonucleotide
  source 1..16: mol_type = other DNA
gttcttggtccgcctg

SEQ ID NO: 1276 - DNA, 16 bp, synthetic construct
  misc_feature 1..16: note = Synthetic oligonucleotide
  source 1..16: mol_type = other DNA
accctctttatccccc

SEQ ID NO: 1277 - DNA, 16 bp, synthetic construct
  misc_feature 1..16: note = Synthetic oligonucleotide
  source 1..16: mol_type = other DNA
tgtgctcagctatgga

SEQ ID NO: 1278 - DNA, 16 bp, synthetic construct
  misc_feature 1..16: note = Synthetic oligonucleotide
  source 1..16: mol_type = other DNA
ttagtctaaagtaaac

SEQ ID NO: 1279 - DNA, 16 bp, synthetic construct
  misc_feature 1..16: note = Synthetic oligonucleotide
  source 1..16: mol_type = other DNA
tgctggttccttcaag

SEQ ID NO: 1280 - DNA, 16 bp, synthetic construct
  misc_feature 1..16: note = Synthetic oligonucleotide
  source 1..16: mol_type = other DNA
tcattcttcggaggac

SEQ ID NO: 1281 - DNA, 16 bp, synthetic construct
  misc_feature 1..16: note = Synthetic oligonucleotide
  source 1..16: mol_type = other DNA
atcaggaagccgctgc

SEQ ID NO: 1282 - DNA, 16 bp, synthetic construct
  misc_feature 1..16: note = Synthetic oligonucleotide
  source 1..16: mol_type = other DNA
atggcccaccacctgc

SEQ ID NO: 1283 - DNA, 16 bp, synthetic construct
  misc_feature 1..16: note = Synthetic oligonucleotide
  source 1..16: mol_type = other DNA
gctaattttctgactg

SEQ ID NO: 1284 - DNA, 16 bp, synthetic construct
  misc_feature 1..16: note = Synthetic oligonucleotide
  source 1..16: mol_type = other DNA
gtcaatcctgggcggc

SEQ ID NO: 1285 - DNA, 16 bp, synthetic construct
  misc_feature 1..16: note = Synthetic oligonucleotide
  source 1..16: mol_type = other DNA
tcatgattgcaaagct

SEQ ID NO: 1286 - DNA, 16 bp, synthetic construct
  misc_feature 1..16: note = Synthetic oligonucleotide
  source 1..16: mol_type = other DNA
agctttgtgaacccat

SEQ ID NO: 1287 - DNA, 16 bp, synthetic construct
  misc_feature 1..16: note = Synthetic oligonucleotide
  source 1..16: mol_type = other DNA
gcccaagcccagtcca

SEQ ID NO: 1288 - DNA, 16 bp, synthetic construct
  misc_feature 1..16: note = Synthetic oligonucleotide
  source 1..16: mol_type = other DNA
agggtatatgaaagtt

SEQ ID NO: 1289 - DNA, 16 bp, synthetic construct
  misc_feature 1..16: note = Synthetic oligonucleotide
  source 1..16: mol_type = other DNA
agccagtgtgtattgc

SEQ ID NO: 1290 - DNA, 16 bp, synthetic construct
  misc_feature 1..16: note = Synthetic oligonucleotide
  source 1..16: mol_type = other DNA
ttgcacccttgaggag

SEQ ID NO: 1291 - DNA, 16 bp, synthetic construct
  misc_feature 1..16: note = Synthetic oligonucleotide
  source 1..16: mol_type = other DNA
gctaggtgccagggta

SEQ ID NO: 1292 - DNA, 16 bp, synthetic construct
  misc_feature 1..16: note = Synthetic oligonucleotide
  source 1..16: mol_type = other DNA
cccccccccccgctga

SEQ ID NO: 1293 - DNA, 16 bp, synthetic construct
  misc_feature 1..16: note = Synthetic oligonucleotide
  source 1..16: mol_type = other DNA
acattcccacagggcc

SEQ ID NO: 1294 - DNA, 16 bp, synthetic construct
  misc_feature 1..16: note = Synthetic oligonucleotide
  source 1..16: mol_type = other DNA
ggatgtggcaaaggac

SEQ ID NO: 1295 - DNA, 16 bp, synthetic construct
  misc_feature 1..16: note = Synthetic oligonucleotide
  source 1..16: mol_type = other DNA
gccctattgtgtggca

SEQ ID NO: 1296 - DNA, 16 bp, synthetic construct
  misc_feature 1..16: note = Synthetic oligonucleotide
  source 1..16: mol_type = other DNA
atttttctttgaccgg

SEQ ID NO: 1297 - DNA, 16 bp, synthetic construct
  misc_feature 1..16: note = Synthetic oligonucleotide
  source 1..16: mol_type = other DNA
acgaagcctcctccag

SEQ ID NO: 1298 - DNA, 16 bp, synthetic construct
  misc_feature 1..16: note = Synthetic oligonucleotide
  source 1..16: mol_type = other DNA
tcacccgataaacctt

SEQ ID NO: 1299 - DNA, 16 bp, synthetic construct
  misc_feature 1..16: note = Synthetic oligonucleotide
  source 1..16: mol_type = other DNA
cccaaacaggcagttt

SEQ ID NO: 1300 - DNA, 16 bp, synthetic construct
  misc_feature 1..16: note = Synthetic oligonucleotide
  source 1..16: mol_type = other DNA
tattcggagacctccc

SEQ ID NO: 1301 - DNA, 16 bp, synthetic construct
  misc_feature 1..16: note = Synthetic oligonucleotide
  source 1..16: mol_type = other DNA
acctgggcaaggctaa

SEQ ID NO: 1302 - DNA, 16 bp, synthetic construct
  misc_feature 1..16: note = Synthetic oligonucleotide
  source 1..16: mol_type = other DNA
cttactccacacctta

SEQ ID NO: 1303 - DNA, 16 bp, synthetic construct
  misc_feature 1..16: note = Synthetic oligonucleotide
  source 1..16: mol_type = other DNA
gtttggtacaaaactg

SEQ ID NO: 1304 - DNA, 16 bp, synthetic construct
  misc_feature 1..16: note = Synthetic oligonucleotide
  source 1..16: mol_type = other DNA
ttgtctcactaaaccc

SEQ ID NO: 1305 - DNA, 16 bp, synthetic construct
  misc_feature 1..16: note = Synthetic oligonucleotide
  source 1..16: mol_type = other DNA
aagaccagtgagatcc

SEQ ID NO: 1306 - DNA, 16 bp, synthetic construct
  misc_feature 1..16: note = Synthetic oligonucleotide
  source 1..16: mol_type = other DNA
aaccacctgtagggac

SEQ ID NO: 1307 - DNA, 16 bp, synthetic construct
  misc_feature 1..16: note = Synthetic oligonucleotide
  source 1..16: mol_type = other DNA
tgggtacttctgttag

SEQ ID NO: 1308 - DNA, 16 bp, synthetic construct
  misc_feature 1..16: note = Synthetic oligonucleotide
  source 1..16: mol_type = other DNA
acagctgtaaccccct

SEQ ID NO: 1309 - DNA, 16 bp, synthetic construct
  misc_feature 1..16: note = Synthetic oligonucleotide
  source 1..16: mol_type = other DNA
tggtggatataaaagc

SEQ ID NO: 1310 - DNA, 16 bp, synthetic construct
  misc_feature 1..16: note = Synthetic oligonucleotide
  source 1..16: mol_type = other DNA
agcgattgtcttgttt

SEQ ID NO: 1311 - DNA, 16 bp, synthetic construct
  misc_feature 1..16: note = Synthetic oligonucleotide
  source 1..16: mol_type = other DNA
tgccgtggcaactctg

SEQ ID NO: 1312 - DNA, 16 bp, synthetic construct
  misc_feature 1..16: note = Synthetic oligonucleotide
  source 1..16: mol_type = other DNA
gtttttcctcagtccc

SEQ ID NO: 1313 - DNA, 16 bp, synthetic construct
  misc_feature 1..16: note = Synthetic oligonucleotide
  source 1..16: mol_type = other DNA
ggcacctccatgttgc

SEQ ID NO: 1314 - DNA, 16 bp, synthetic construct
  misc_feature 1..16: note = Synthetic oligonucleotide
  source 1..16: mol_type = other DNA
tgctggtcttgggcac

SEQ ID NO: 1315 - DNA, 16 bp, synthetic construct
  misc_feature 1..16: note = Synthetic oligonucleotide
  source 1..16: mol_type = other DNA
ccttatagcttacctg

SEQ ID NO: 1316 - DNA, 16 bp, synthetic construct
  misc_feature 1..16: note = Synthetic oligonucleotide
  source 1..16: mol_type = other DNA
agagtcaccgcccaaa

SEQ ID NO: 1317 - DNA, 16 bp, synthetic construct
  misc_feature 1..16: note = Synthetic oligonucleotide
  source 1..16: mol_type = other DNA
cttgccgtgcacacac

SEQ ID NO: 1318 - DNA, 16 bp, synthetic construct
  misc_feature 1..16: note = Synthetic oligonucleotide
  source 1..16: mol_type = other DNA
tggtttgcagggatct

SEQ ID NO: 1319 - DNA, 16 bp, synthetic construct
  misc_feature 1..16: note = Synthetic oligonucleotide
  source 1..16: mol_type = other DNA
acaaagaactcaagtc

SEQ ID NO: 1320 - DNA, 16 bp, synthetic construct
  misc_feature 1..16: note = Synthetic oligonucleotide
  source 1..16: mol_type = other DNA
gactgctccctgtaat

SEQ ID NO: 1321 - DNA, 16 bp, synthetic construct
  misc_feature 1..16: note = Synthetic oligonucleotide
  source 1..16: mol_type = other DNA
atgtgtttaggcattc

SEQ ID NO: 1322 - DNA, 16 bp, synthetic construct
  misc_feature 1..16: note = Synthetic oligonucleotide
  source 1..16: mol_type = other DNA
cattgggttatgaaat

SEQ ID NO: 1323 - DNA, 16 bp, synthetic construct
  misc_feature 1..16: note = Synthetic oligonucleotide
  source 1..16: mol_type = other DNA
catgcctgttgggtca

SEQ ID NO: 1324 - DNA, 16 bp, synthetic construct
  misc_feature 1..16: note = Synthetic oligonucleotide
  source 1..16: mol_type = other DNA
gctcagcaccaacatg

SEQ ID NO: 1325 - DNA, 16 bp, synthetic construct
  misc_feature 1..16: note = Synthetic oligonucleotide
  source 1..16: mol_type = other DNA
actccaacccttttgg

SEQ ID NO: 1326 - DNA, 16 bp, synthetic construct
  misc_feature 1..16: note = Synthetic oligonucleotide
  source 1..16: mol_type = other DNA
attctattagagggct

SEQ ID NO: 1327 - DNA, 16 bp, synthetic construct
  misc_feature 1..16: note = Synthetic oligonucleotide
  source 1..16: mol_type = other DNA
aagctttaaactcagg

SEQ ID NO: 1328 - DNA, 16 bp, synthetic construct
  misc_feature 1..16: note = Synthetic oligonucleotide
  source 1..16: mol_type = other DNA
cttgttttatggagtc

SEQ ID NO: 1329 - DNA, 16 bp, synthetic construct
  misc_feature 1..16: note = Synthetic oligonucleotide
  source 1..16: mol_type = other DNA
agtgcataacagccat

SEQ ID NO: 1330 - DNA, 16 bp, synthetic construct
  misc_feature 1..16: note = Synthetic oligonucleotide
  source 1..16: mol_type = other DNA
ccaagatataccgagg

SEQ ID NO: 1331 - DNA, 16 bp, synthetic construct
  misc_feature 1..16: note = Synthetic oligonucleotide
  source 1..16: mol_type = other DNA
aatcttcccctggcag

SEQ ID NO: 1332 - DNA, 16 bp, synthetic construct
  misc_feature 1..16: note = Synthetic oligonucleotide
  source 1..16: mol_type = other DNA
accctcgctccagctt

SEQ ID NO: 1333 - DNA, 16 bp, synthetic construct
  misc_feature 1..16: note = Synthetic oligonucleotide
  source 1..16: mol_type = other DNA
gggcttactttgagga

SEQ ID NO: 1334 - DNA, 16 bp, synthetic construct
  misc_feature 1..16: note = Synthetic oligonucleotide
  source 1..16: mol_type = other DNA
gtactgctggccttta

SEQ ID NO: 1335 - DNA, 16 bp, synthetic construct
  misc_feature 1..16: note = Synthetic oligonucleotide
  source 1..16: mol_type = other DNA
acggagccttcttatg

SEQ ID NO: 1336 - DNA, 16 bp, synthetic construct
  misc_feature 1..16: note = Synthetic oligonucleotide
  source 1..16: mol_type = other DNA
gtggtgcctttgtgga

SEQ ID NO: 1337 - DNA, 16 bp, synthetic construct
  misc_feature 1..16: note = Synthetic oligonucleotide
  source 1..16: mol_type = other DNA
ccagacccatgccgac

SEQ ID NO: 1338 - DNA, 16 bp, synthetic construct
  misc_feature 1..16: note = Synthetic oligonucleotide
  source 1..16: mol_type = other DNA
aaagcggctgtgattc

SEQ ID NO: 1339 - DNA, 16 bp, synthetic construct
  misc_feature 1..16: note = Synthetic oligonucleotide
  source 1..16: mol_type = other DNA
ttctttccgtagtcca

SEQ ID NO: 1340 - DNA, 16 bp, synthetic construct
  misc_feature 1..16: note = Synthetic oligonucleotide
  source 1..16: mol_type = other DNA
tcacccaaaaactccc

SEQ ID NO: 1341 - DNA, 16 bp, synthetic construct
  misc_feature 1..16: note = Synthetic oligonucleotide
  source 1..16: mol_type = other DNA
agggcacggatgtcct

SEQ ID NO: 1342 - DNA, 16 bp, synthetic construct
  misc_feature 1..16: note = Synthetic oligonucleotide
  source 1..16: mol_type = other DNA
gagattggctcagtga

SEQ ID NO: 1343 - DNA, 16 bp, synthetic construct
  misc_feature 1..16: note = Synthetic oligonucleotide
  source 1..16: mol_type = other DNA
gctgggttcattaacc

SEQ ID NO: 1344 - DNA, 16 bp, synthetic construct
  misc_feature 1..16: note = Synthetic oligonucleotide
  source 1..16: mol_type = other DNA
taagtgctttgattcg

SEQ ID NO: 1345 - DNA, 16 bp, synthetic construct
  misc_feature 1..16: note = Synthetic oligonucleotide
  source 1..16: mol_type = other DNA
agttcttggtccgcct

SEQ ID NO: 1346 - DNA, 16 bp, synthetic construct
  misc_feature 1..16: note = Synthetic oligonucleotide
  source 1..16: mol_type = other DNA
caccctctttatcccc

SEQ ID NO: 1347 - DNA, 16 bp, synthetic construct
  misc_feature 1..16: note = Synthetic oligonucleotide
  source 1..16: mol_type = other DNA
ctgtgctcagctatgg

SEQ ID NO: 1348 - DNA, 16 bp, synthetic construct
  misc_feature 1..16: note = Synthetic oligonucleotide
  source 1..16: mol_type = other DNA
ctttagtctaaagtaa

SEQ ID NO: 1349 - DNA, 16 bp, synthetic construct
  misc_feature 1..16: note = Synthetic oligonucleotide
  source 1..16: mol_type = other DNA
actcttgggctttctc

SEQ ID NO: 1350 - DNA, 16 bp, synthetic construct
  misc_feature 1..16: note = Synthetic oligonucleotide
  source 1..16: mol_type = other DNA
ttcattcttcggagga

SEQ ID NO: 1351 - DNA, 16 bp, synthetic construct
  misc_feature 1..16: note = Synthetic oligonucleotide
  source 1..16: mol_type = other DNA
catcaggaagccgctg

SEQ ID NO: 1352 - DNA, 16 bp, synthetic construct
  misc_feature 1..16: note = Synthetic oligonucleotide
  source 1..16: mol_type = other DNA
gccatggcccaccacc

SEQ ID NO: 1353 - DNA, 16 bp, synthetic construct
  misc_feature 1..16: note = Synthetic oligonucleotide
  source 1..16: mol_type = other DNA
gctttcatgctaattt

SEQ ID NO: 1354 - DNA, 16 bp, synthetic construct
  misc_feature 1..16: note = Synthetic oligonucleotide
  source 1..16: mol_type = other DNA
ggtcaatcctgggcgg

SEQ ID NO: 1355 - DNA, 16 bp, synthetic construct
  misc_feature 1..16: note = Synthetic oligonucleotide
  source 1..16: mol_type = other DNA
ctcatgattgcaaagc

SEQ ID NO: 1356 - DNA, 16 bp, synthetic construct
  misc_feature 1..16: note = Synthetic oligonucleotide
  source 1..16: mol_type = other DNA
ctcagcagtcaaaacc

SEQ ID NO: 1357 - DNA, 16 bp, synthetic construct
  misc_feature 1..16: note = Synthetic oligonucleotide
  source 1..16: mol_type = other DNA
gttcctagaagaagcc

SEQ ID NO: 1358 - DNA, 16 bp, synthetic construct
  misc_feature 1..16: note = Synthetic oligonucleotide
  source 1..16: mol_type = other DNA
gagggtatatgaaagt

SEQ ID NO: 1359 - DNA, 16 bp, synthetic construct
  misc_feature 1..16: note = Synthetic oligonucleotide
  source 1..16: mol_type = other DNA
tagctggtgatagcca

SEQ ID NO: 1360 - DNA, 16 bp, synthetic construct
  misc_feature 1..16: note = Synthetic oligonucleotide
  source 1..16: mol_type = other DNA
tgttgcacccttgagg

SEQ ID NO: 1361 - DNA, 16 bp, synthetic construct
  misc_feature 1..16: note = Synthetic oligonucleotide
  source 1..16: mol_type = other DNA
tcatttgctaggtgcc

SEQ ID NO: 1362 - DNA, 16 bp, synthetic construct
  misc_feature 1..16: note = Synthetic oligonucleotide
  source 1..16: mol_type = other DNA
ggtcaacctcctctcc

SEQ ID NO: 1363 - DNA, 16 bp, synthetic construct
  misc_feature 1..16: note = Synthetic oligonucleotide
  source 1..16: mol_type = other DNA
tacattcccacagggc

SEQ ID NO: 1364 - DNA, 16 bp, synthetic construct
  misc_feature 1..16: note = Synthetic oligonucleotide
  source 1..16: mol_type = other DNA
cgccaggtcacacaga

SEQ ID NO: 1365 - DNA, 16 bp, synthetic construct
  misc_feature 1..16: note = Synthetic oligonucleotide
  source 1..16: mol_type = other DNA
ggccctattgtgtggc

SEQ ID NO: 1366 - DNA, 16 bp, synthetic construct
  misc_feature 1..16: note = Synthetic oligonucleotide
  source 1..16: mol_type = other DNA
gatttttctttgaccg

SEQ ID NO: 1367 - DNA, 16 bp, synthetic construct
  misc_feature 1..16: note = Synthetic oligonucleotide
  source 1..16: mol_type = other DNA
cacgaagcctcctcca

SEQ ID NO: 1368 - DNA, 16 bp, synthetic construct
  misc_feature 1..16: note = Synthetic oligonucleotide
  source 1..16: mol_type = other DNA
ttcacccgataaacct

SEQ ID NO: 1369 - DNA, 16 bp, synthetic construct
  misc_feature 1..16: note = Synthetic oligonucleotide
  source 1..16: mol_type = other DNA
acccaaacaggcagtt

SEQ ID NO: 1370 - DNA, 16 bp, synthetic construct
  misc_feature 1..16: note = Synthetic oligonucleotide
  source 1..16: mol_type = other DNA
gtattcggagacctcc

SEQ ID NO: 1371 - DNA, 16 bp, synthetic construct
  misc_feature 1..16: note = Synthetic oligonucleotide
  source 1..16: mol_type = other DNA
aacctgggcaaggcta

SEQ ID NO: 1372 - DNA, 16 bp, synthetic construct
  misc_feature 1..16: note = Synthetic oligonucleotide
  source 1..16: mol_type = other DNA
tgcttactccacacct

SEQ ID NO: 1373 - DNA, 16 bp, synthetic construct
  misc_feature 1..16: note = Synthetic oligonucleotide
  source 1..16: mol_type = other DNA
ccatgtttggtacaaa

SEQ ID NO: 1374 - DNA, 16 bp, synthetic construct
  misc_feature 1..16: note = Synthetic oligonucleotide
  source 1..16: mol_type = other DNA
cttgtctcactaaacc

SEQ ID NO: 1375 - DNA, 16 bp, synthetic construct
  misc_feature 1..16: note = Synthetic oligonucleotide
  source 1..16: mol_type = other DNA
taagaccagtgagatc

SEQ ID NO: 1376 - DNA, 16 bp, synthetic construct
  misc_feature 1..16: note = Synthetic oligonucleotide
  source 1..16: mol_type = other DNA
aaaccacctgtaggga

SEQ ID NO: 1377 - DNA, 16 bp, synthetic construct
  misc_feature 1..16: note = Synthetic oligonucleotide
  source 1..16: mol_type = other DNA
atgggtacttctgtta

SEQ ID NO: 1378 - DNA, 16 bp, synthetic construct
  misc_feature 1..16: note = Synthetic oligonucleotide
  source 1..16: mol_type = other DNA
tagaacagctgtaacc

SEQ ID NO: 1379 - DNA, 16 bp, synthetic construct
  misc_feature 1..16: note = Synthetic oligonucleotide
  source 1..16: mol_type = other DNA
gctggtggatataaaa

SEQ ID NO: 1380 - DNA, 16 bp, synthetic construct
  misc_feature 1..16: note = Synthetic oligonucleotide
  source 1..16: mol_type = other DNA
gagcgattgtcttgtt

SEQ ID NO: 1381 - DNA, 16 bp, synthetic construct
  misc_feature 1..16: note = Synthetic oligonucleotide
  source 1..16: mol_type = other DNA
ttgccgtggcaactct

SEQ ID NO: 1382 - DNA, 16 bp, synthetic construct
  misc_feature 1..16: note = Synthetic oligonucleotide
  source 1..16: mol_type = other DNA
agtttttcctcagtcc

SEQ ID NO: 1383 - DNA, 16 bp, synthetic construct
  misc_feature 1..16: note = Synthetic oligonucleotide
  source 1..16: mol_type = other DNA
aggcacctccatgttg

SEQ ID NO: 1384 - DNA, 16 bp, synthetic construct
  misc_feature 1..16: note = Synthetic oligonucleotide
  source 1..16: mol_type = other DNA
ggagattcctcctgct

SEQ ID NO: 1385 - DNA, 16 bp, synthetic construct
  misc_feature 1..16: note = Synthetic oligonucleotide
  source 1..16: mol_type = other DNA
cccttatagcttacct

SEQ ID NO: 1386 - DNA, 16 bp, synthetic construct
  misc_feature 1..16: note = Synthetic oligonucleotide
  source 1..16: mol_type = other DNA
gagagtcaccgcccaa

SEQ ID NO: 1387 - DNA, 16 bp, synthetic construct
  misc_feature 1..16: note = Synthetic oligonucleotide
  source 1..16: mol_type = other DNA
tcttgccgtgcacaca

SEQ ID NO: 1388 - DNA, 16 bp, synthetic construct
  misc_feature 1..16: note = Synthetic oligonucleotide
  source 1..16: mol_type = other DNA
gtggtttgcagggatc

SEQ ID NO: 1389 - DNA, 16 bp, synthetic construct
  misc_feature 1..16: note = Synthetic oligonucleotide
  source 1..16: mol_type = other DNA
ggtctacaaagaactc

SEQ ID NO: 1390 - DNA, 16 bp, synthetic construct
  misc_feature 1..16: note = Synthetic oligonucleotide
  source 1..16: mol_type = other DNA
ggactgctccctgtaa

SEQ ID NO: 1391 - DNA, 16 bp, synthetic construct
  misc_feature 1..16: note = Synthetic oligonucleotide
  source 1..16: mol_type = other DNA
gatgtgtttaggcatt

SEQ ID NO: 1392 - DNA, 16 bp, synthetic construct
  misc_feature 1..16: note = Synthetic oligonucleotide
  source 1..16: mol_type = other DNA
atcattgggttatgaa

SEQ ID NO: 1393 - DNA, 16 bp, synthetic construct
  misc_feature 1..16: note = Synthetic oligonucleotide
  source 1..16: mol_type = other DNA
acatgcctgttgggtc

SEQ ID NO: 1394 - DNA, 16 bp, synthetic construct
  misc_feature 1..16: note = Synthetic oligonucleotide
  source 1..16: mol_type = other DNA
agctcagcaccaacat

SEQ ID NO: 1395 - DNA, 16 bp, synthetic construct
  misc_feature 1..16: note = Synthetic oligonucleotide
  source 1..16: mol_type = other DNA
gactccaacccttttg

SEQ ID NO: 1396 - DNA, 16 bp, synthetic construct
  misc_feature 1..16: note = Synthetic oligonucleotide
  source 1..16: mol_type = other DNA
aattctattagagggc

SEQ ID NO: 1397 - DNA, 16 bp, synthetic construct
  misc_feature 1..16: note = Synthetic oligonucleotide
  source 1..16: mol_type = other DNA
gaagctttaaactcag

SEQ ID NO: 1398 - DNA, 16 bp, synthetic construct
  misc_feature 1..16: note = Synthetic oligonucleotide
  source 1..16: mol_type = other DNA
acttgttttatggagt

SEQ ID NO: 1399 - DNA, 16 bp, synthetic construct
  misc_feature 1..16: note = Synthetic oligonucleotide
  source 1..16: mol_type = other DNA
gagtgcataacagcca

SEQ ID NO: 1400 - DNA, 16 bp, synthetic construct
  misc_feature 1..16: note = Synthetic oligonucleotide
  source 1..16: mol_type = other DNA
acaggtcctccagtcc

SEQ ID NO: 1401 - DNA, 16 bp, synthetic construct
  misc_feature 1..16: note = Synthetic oligonucleotide
  source 1..16: mol_type = other DNA
tgtcgctgcagggcct

SEQ ID NO: 1402 - DNA, 16 bp, synthetic construct
  misc_feature 1..16: note = Synthetic oligonucleotide
  source 1..16: mol_type = other DNA
ttttgttgcaccctcg

SEQ ID NO: 1403 - DNA, 16 bp, synthetic construct
  misc_feature 1..16: note = Synthetic oligonucleotide
  source 1..16: mol_type = other DNA
tgctctctgggtccat

SEQ ID NO: 1404 - DNA, 16 bp, synthetic construct
  misc_feature 1..16: note = Synthetic oligonucleotide
  source 1..16: mol_type = other DNA
ccagtttctgtactgc

SEQ ID NO: 1405 - DNA, 16 bp, synthetic construct
  misc_feature 1..16: note = Synthetic oligonucleotide
  source 1..16: mol_type = other DNA
atctgcaagggcacgg

SEQ ID NO: 1406 - DNA, 16 bp, synthetic construct
  misc_feature 1..16: note = Synthetic oligonucleotide
  source 1..16: mol_type = other DNA
ttggcgatggtggtgc

SEQ ID NO: 1407 - DNA, 16 bp, synthetic construct
  misc_feature 1..16: note = Synthetic oligonucleotide
  source 1..16: mol_type = other DNA
ccctctgtgaagggtg

SEQ ID NO: 1408 - DNA, 16 bp, synthetic construct
  misc_feature 1..16: note = Synthetic oligonucleotide
  source 1..16: mol_type = other DNA
gtaatcccggtcaaag

SEQ ID NO: 1409 - DNA, 16 bp, synthetic construct
  misc_feature 1..16: note = Synthetic oligonucleotide
  source 1..16: mol_type = other DNA
gtgtccaccacttctt

SEQ ID NO: 1410 - DNA, 16 bp, synthetic construct
  misc_feature 1..16: note = Synthetic oligonucleotide
  source 1..16: mol_type = other DNA
gtattgccagctaagg

SEQ ID NO: 1411 - DNA, 16 bp, synthetic construct
  misc_feature 1..16: note = Synthetic oligonucleotide
  source 1..16: mol_type = other DNA
aagattggctctggct

SEQ ID NO: 1412 - DNA, 16 bp, synthetic construct
  misc_feature 1..16: note = Synthetic oligonucleotide
  source 1..16: mol_type = other DNA
ccgctttcagctgaga

SEQ ID NO: 1413 - DNA, 16 bp, synthetic construct
  misc_feature 1..16: note = Synthetic oligonucleotide
  source 1..16: mol_type = other DNA
gagcttgactcctctg

SEQ ID NO: 1414 - DNA, 16 bp, synthetic construct
  misc_feature 1..16: note = Synthetic oligonucleotide
  source 1..16: mol_type = other DNA
gccccctcatgtaagt

SEQ ID NO: 1415 - DNA, 16 bp, synthetic construct
  misc_feature 1..16: note = Synthetic oligonucleotide
  source 1..16: mol_type = other DNA
atatctctcctggtgg

SEQ ID NO: 1416 - DNA, 16 bp, synthetic construct
  misc_feature 1..16: note = Synthetic oligonucleotide
  source 1..16: mol_type = other DNA
ataaactttacctcac

SEQ ID NO: 1417 - DNA, 16 bp, synthetic construct
  misc_feature 1..16: note = Synthetic oligonucleotide
  source 1..16: mol_type = other DNA
cttctccttgctgcac

SEQ ID NO: 1418 - DNA, 16 bp, synthetic construct
  misc_feature 1..16: note = Synthetic oligonucleotide
  source 1..16: mol_type = other DNA
cacccggccccccaat

SEQ ID NO: 1419 - DNA, 16 bp, synthetic construct
  misc_feature 1..16: note = Synthetic oligonucleotide
  source 1..16: mol_type = other DNA
atccaactgttctaac

SEQ ID NO: 1420 - DNA, 16 bp, synthetic construct
  misc_feature 1..16: note = Synthetic oligonucleotide
  source 1..16: mol_type = other DNA
atatgcccccaggagg

SEQ ID NO: 1421 - DNA, 16 bp, synthetic construct
  misc_feature 1..16: note = Synthetic oligonucleotide
  source 1..16: mol_type = other DNA
caccccaatgaccatc

SEQ ID NO: 1422 - DNA, 16 bp, synthetic construct
  misc_feature 1..16: note = Synthetic oligonucleotide
  source 1..16: mol_type = other DNA
tggttctcacatactc

SEQ ID NO: 1423 - DNA, 16 bp, synthetic construct
  misc_feature 1..16: note = Synthetic oligonucleotide
  source 1..16: mol_type = other DNA
ctagagatctgagctt

SEQ ID NO: 1424 - DNA, 16 bp, synthetic construct
  misc_feature 1..16: note = Synthetic oligonucleotide
  source 1..16: mol_type = other DNA
cagcttgatgagtagg

SEQ ID NO: 1425 - DNA, 16 bp, synthetic construct
  misc_feature 1..16: note = Synthetic oligonucleotide
  source 1..16: mol_type = other DNA
gggcctcctccttgag

SEQ ID NO: 1426 - DNA, 16 bp, synthetic construct
  misc_feature 1..16: note = Synthetic oligonucleotide
  source 1..16: mol_type = other DNA
aagttggtgctcagac

SEQ ID NO: 1427 - DNA, 16 bp, synthetic construct
  misc_feature 1..16: note = Synthetic oligonucleotide
  source 1..16: mol_type = other DNA
acagcgggtcctccct

SEQ ID NO: 1428 - DNA, 16 bp, synthetic construct
  misc_feature 1..16: note = Synthetic oligonucleotide
  source 1..16: mol_type = other DNA
tcgcataaaactttgc

SEQ ID NO: 1429 - DNA, 16 bp, synthetic construct
  misc_feature 1..16: note = Synthetic oligonucleotide
  source 1..16: mol_type = other DNA
cagaggacgggcagcc

SEQ ID NO: 1430 - DNA, 16 bp, synthetic construct
  misc_feature 1..16: note = Synthetic oligonucleotide
  source 1..16: mol_type = other DNA
agtccatccgggttct

SEQ ID NO: 1431 - DNA, 16 bp, synthetic construct
  misc_feature 1..16: note = Synthetic oligonucleotide
  source 1..16: mol_type = other DNA
cccacttgagtcattt

SEQ ID NO: 1432 - DNA, 16 bp, synthetic construct
  misc_feature 1..16: note = Synthetic oligonucleotide
  source 1..16: mol_type = other DNA
agagcgggaggtgaca

SEQ ID NO: 1433 - DNA, 16 bp, synthetic construct
  misc_feature 1..16: note = Synthetic oligonucleotide
  source 1..16: mol_type = other DNA
tcaggcccgatacatt

SEQ ID NO: 1434 - DNA, 16 bp, synthetic construct
  misc_feature 1..16: note = Synthetic oligonucleotide
  source 1..16: mol_type = other DNA
attattctcatggtac

SEQ ID NO: 1435 - DNA, 16 bp, synthetic construct
  misc_feature 1..16: note = Synthetic oligonucleotide
  source 1..16: mol_type = other DNA
ccttagggaggcccta

SEQ ID NO: 1436 - DNA, 16 bp, synthetic construct
  misc_feature 1..16: note = Synthetic oligonucleotide
  source 1..16: mol_type = other DNA
aaaattctattgggcc

SEQ ID NO: 1437 - DNA, 16 bp, synthetic construct
  misc_feature 1..16: note = Synthetic oligonucleotide
  source 1..16: mol_type = other DNA
ttttcaccatagcacg

SEQ ID NO: 1438 - DNA, 16 bp, synthetic construct
  misc_feature 1..16: note = Synthetic oligonucleotide
  source 1..16: mol_type = other DNA
gtccttactgcagttt

SEQ ID NO: 1439 - DNA, 16 bp, synthetic construct
  misc_feature 1..16: note = Synthetic oligonucleotide
  source 1..16: mol_type = other DNA
cagggattttccaaca

SEQ ID NO: 1440 - DNA, 16 bp, synthetic construct
  misc_feature 1..16: note = Synthetic oligonucleotide
  source 1..16: mol_type = other DNA
gtctcacctgtattcg

SEQ ID NO: 1441 - DNA, 16 bp, synthetic construct
  misc_feature 1..16: note = Synthetic oligonucleotide
  source 1..16: mol_type = other DNA
ttgcactaaaagctga

SEQ ID NO: 1442 - DNA, 16 bp, synthetic construct
  misc_feature 1..16: note = Synthetic oligonucleotide
  source 1..16: mol_type = other DNA
ccagaaatccttatgc

SEQ ID NO: 1443 - DNA, 16 bp, synthetic construct
  misc_feature 1..16: note = Synthetic oligonucleotide
  source 1..16: mol_type = other DNA
gttccatgtatgccca

SEQ ID NO: 1444 - DNA, 16 bp, synthetic construct
  misc_feature 1..16: note = Synthetic oligonucleotide
  source 1..16: mol_type = other DNA
acactcaatcataccc

SEQ ID NO: 1445 - DNA, 16 bp, synthetic construct
  misc_feature 1..16: note = Synthetic oligonucleotide
  source 1..16: mol_type = other DNA
ccaattcagctaagac

SEQ ID NO: 1446 - DNA, 16 bp, synthetic construct
  misc_feature 1..16: note = Synthetic oligonucleotide
  source 1..16: mol_type = other DNA
aggagttgctgaaacc

SEQ ID NO: 1447 - DNA, 16 bp, synthetic construct
  misc_feature 1..16: note = Synthetic oligonucleotide
  source 1..16: mol_type = other DNA
gtcatatcagatgggt

SEQ ID NO: 1448 - DNA, 16 bp, synthetic construct
  misc_feature 1..16: note = Synthetic oligonucleotide
  source 1..16: mol_type = other DNA
ctacgaggcctttaga

SEQ ID NO: 1449 - DNA, 16 bp, synthetic construct
  misc_feature 1..16: note = Synthetic oligonucleotide
  source 1..16: mol_type = other DNA
cctctggcactaaatc

SEQ ID NO: 1450 - DNA, 16 bp, synthetic construct
  misc_feature 1..16: note = Synthetic oligonucleotide
  source 1..16: mol_type = other DNA
tggctgggcgagcgat

SEQ ID NO: 1451 - DNA, 16 bp, synthetic construct
  misc_feature 1..16: note = Synthetic oligonucleotide
  source 1..16: mol_type = other DNA
ctgacttggttgccgt

SEQ ID NO: 1452 - DNA, 16 bp, synthetic construct
  misc_feature 1..16: note = Synthetic oligonucleotide
  source 1..16: mol_type = other DNA
gggcctgttattaaac

SEQ ID NO: 1453 - DNA, 16 bp, synthetic construct
  misc_feature 1..16: note = Synthetic oligonucleotide
  source 1..16: mol_type = other DNA
tgatccttgaggcacc

SEQ ID NO: 1454 - DNA, 16 bp, synthetic construct
  misc_feature 1..16: note = Synthetic oligonucleotide
  source 1..16: mol_type = other DNA
aactaccatgcaaagg

SEQ ID NO: 1455 - DNA, 16 bp, synthetic construct
  misc_feature 1..16: note = Synthetic oligonucleotide
  source 1..16: mol_type = other DNA
actccttatgttttga

SEQ ID NO: 1456 - DNA, 16 bp, synthetic construct
  misc_feature 1..16: note = Synthetic oligonucleotide
  source 1..16: mol_type = other DNA
ccagacagcgagagtc

SEQ ID NO: 1457 - DNA, 16 bp, synthetic construct
  misc_feature 1..16: note = Synthetic oligonucleotide
  source 1..16: mol_type = other DNA
gcatgatgtaaaattg

SEQ ID NO: 1458 - DNA, 16 bp, synthetic construct
  misc_feature 1..16: note = Synthetic oligonucleotide
  source 1..16: mol_type = other DNA
aggattactcctgaag

SEQ ID NO: 1459 - DNA, 16 bp, synthetic construct
  misc_feature 1..16: note = Synthetic oligonucleotide
  source 1..16: mol_type = other DNA
aaataatggtaggtct

SEQ ID NO: 1460 - DNA, 16 bp, synthetic construct
  misc_feature 1..16: note = Synthetic oligonucleotide
  source 1..16: mol_type = other DNA
ggtatattcctgacca

SEQ ID NO: 1461 - DNA, 16 bp, synthetic construct
  misc_feature 1..16: note = Synthetic oligonucleotide
  source 1..16: mol_type = other DNA
tggaatccagatgtgt

SEQ ID NO: 1462 - DNA, 16 bp, synthetic construct
  misc_feature 1..16: note = Synthetic oligonucleotide
  source 1..16: mol_type = other DNA
aatatcaacacatcat

SEQ ID NO: 1463 - DNA, 16 bp, synthetic construct
  misc_feature 1..16: note = Synthetic oligonucleotide
  source 1..16: mol_type = other DNA
ccagtgatcacttcca

SEQ ID NO: 1464 - DNA, 16 bp, synthetic construct
  misc_feature 1..16: note = Synthetic oligonucleotide
  source 1..16: mol_type = other DNA
aacattgaaacaccag

SEQ ID NO: 1465 - DNA, 16 bp, synthetic construct
  misc_feature 1..16: note = Synthetic oligonucleotide
  source 1..16: mol_type = other DNA
agcttccataagccag

SEQ ID NO: 1466 - DNA, 16 bp, synthetic construct
  misc_feature 1..16: note = Synthetic oligonucleotide
  source 1..16: mol_type = other DNA
ggtagggctctaattc

SEQ ID NO: 1467 - DNA, 16 bp, synthetic construct
  misc_feature 1..16: note = Synthetic oligonucleotide
  source 1..16: mol_type = other DNA
tagagggaattgtgtg

SEQ ID NO: 1468 - DNA, 16 bp, synthetic construct
  misc_feature 1..16: note = Synthetic oligonucleotide
  source 1..16: mol_type = other DNA
gctgtgatgtgggact

SEQ ID NO: 1469 - DNA, 16 bp, synthetic construct
  misc_feature 1..16: note = Synthetic oligonucleotide
  source 1..16: mol_type = other DNA
gaaagtgtgggagtgc

SEQ ID NO: 1470 - DNA, 16 bp, synthetic construct
  misc_feature 1..16: note = Synthetic oligonucleotide
  source 1..16: mol_type = other DNA
gacaggtcctccagtc

SEQ ID NO: 1471 - DNA, 16 bp, synthetic construct
  misc_feature 1..16: note = Synthetic oligonucleotide
  source 1..16: mol_type = other DNA
atgtcgctgcagggcc

SEQ ID NO: 1472 - DNA, 16 bp, synthetic construct
  misc_feature 1..16: note = Synthetic oligonucleotide
  source 1..16: mol_type = other DNA
tactgctctctgggtc

SEQ ID NO: 1473 - DNA, 16 bp, synthetic construct
  misc_feature 1..16: note = Synthetic oligonucleotide
  source 1..16: mol_type = other DNA
accagtttctgtactg

SEQ ID NO: 1474 - DNA, 16 bp, synthetic construct
  misc_feature 1..16: note = Synthetic oligonucleotide
  source 1..16: mol_type = other DNA
catctgcaagggcacg

SEQ ID NO: 1475 - DNA, 16 bp, synthetic construct
  misc_feature 1..16: note = Synthetic oligonucleotide
  source 1..16: mol_type = other DNA
attggcgatggtggtg

SEQ ID NO: 1476 - DNA, 16 bp, synthetic construct
  misc_feature 1..16: note = Synthetic oligonucleotide
  source 1..16: mol_type = other DNA
tccctctgtgaagggt

SEQ ID NO: 1477 - DNA, 16 bp, synthetic construct
  misc_feature 1..16: note = Synthetic oligonucleotide
  source 1..16: mol_type = other DNA
ctggtaatcccggtca

SEQ ID NO: 1478 - DNA, 16 bp, synthetic construct
  misc_feature 1..16: note = Synthetic oligonucleotide
  source 1..16: mol_type = other DNA
tgtgtccaccacttct

SEQ ID NO: 1479 - DNA, 16 bp, synthetic construct
  misc_feature 1..16: note = Synthetic oligonucleotide
  source 1..16: mol_type = other DNA
agtattgccagctaag

SEQ ID NO: 1480 - DNA, 16 bp, synthetic construct
  misc_feature 1..16: note = Synthetic oligonucleotide
  source 1..16: mol_type = other DNA
gaagattggctctggc

SEQ ID NO: 1481 - DNA, 16 bp, synthetic construct
  misc_feature 1..16: note = Synthetic oligonucleotide
  source 1..16: mol_type = other DNA
accgctttcagctgag

SEQ ID NO: 1482 - DNA, 16 bp, synthetic construct
  misc_feature 1..16: note = Synthetic oligonucleotide
  source 1..16: mol_type = other DNA
tgagcttgactcctct

SEQ ID NO: 1483 - DNA, 16 bp, synthetic construct
  misc_feature 1..16: note = Synthetic oligonucleotide
  source 1..16: mol_type = other DNA
tgccccctcatgtaag

SEQ ID NO: 1484 - DNA, 16 bp, synthetic construct
  misc_feature 1..16: note = Synthetic oligonucleotide
  source 1..16: mol_type = other DNA
gcatatctctcctggt

SEQ ID NO: 1485 - DNA, 16 bp, synthetic construct
  misc_feature 1..16: note = Synthetic oligonucleotide
  source 1..16: mol_type = other DNA
ctcagttccataaact

SEQ ID NO: 1486 - DNA, 16 bp, synthetic construct
  misc_feature 1..16: note = Synthetic oligonucleotide
  source 1..16: mol_type = other DNA
gccttctccttgctgc

SEQ ID NO: 1487 - DNA, 16 bp, synthetic construct
  misc_feature 1..16: note = Synthetic oligonucleotide
  source 1..16: mol_type = other DNA
acacccggccccccaa

SEQ ID NO: 1488 - DNA, 16 bp, synthetic construct
  misc_feature 1..16: note = Synthetic oligonucleotide
  source 1..16: mol_type = other DNA
tatccaactgttctaa

SEQ ID NO: 1489 - DNA, 16 bp, synthetic construct
  misc_feature 1..16: note = Synthetic oligonucleotide
  source 1..16: mol_type = other DNA
gatatgcccccaggag

SEQ ID NO: 1490 - DNA, 16 bp, synthetic construct
  misc_feature 1..16: note = Synthetic oligonucleotide
  source 1..16: mol_type = other DNA
ccaccccaatgaccat

SEQ ID NO: 1491 - DNA, 16 bp, synthetic construct
  misc_feature 1..16: note = Synthetic oligonucleotide
  source 1..16: mol_type = other DNA
ttggttctcacatact

SEQ ID NO: 1492 - DNA, 16 bp, synthetic construct
  misc_feature 1..16: note = Synthetic oligonucleotide
  source 1..16: mol_type = other DNA
tctagagatctgagct

SEQ ID NO: 1493 - DNA, 16 bp, synthetic construct
  misc_feature 1..16: note = Synthetic oligonucleotide
  source 1..16: mol_type = other DNA
ccagcttgatgagtag

SEQ ID NO: 1494 - DNA, 16 bp, synthetic construct
  misc_feature 1..16: note = Synthetic oligonucleotide
  source 1..16: mol_type = other DNA
caagttggtgctcaga

SEQ ID NO: 1495 - DNA, 16 bp, synthetic construct
  misc_feature 1..16: note = Synthetic oligonucleotide
  source 1..16: mol_type = other DNA
tcaactaggatacagc

SEQ ID NO: 1496 - DNA, 16 bp, synthetic construct
  misc_feature 1..16: note = Synthetic oligonucleotide
  source 1..16: mol_type = other DNA
atccttcttcgcataa

SEQ ID NO: 1497 - DNA, 16 bp, synthetic construct
  misc_feature 1..16: note = Synthetic oligonucleotide
  source 1..16: mol_type = other DNA
aatcagaggacgggca

SEQ ID NO: 1498 - DNA, 16 bp, synthetic construct
  misc_feature 1..16: note = Synthetic oligonucleotide
  source 1..16: mol_type = other DNA
ctagtccatccgggtt

SEQ ID NO: 1499 - DNA, 16 bp, synthetic construct
  misc_feature 1..16: note = Synthetic oligonucleotide
  source 1..16: mol_type = other DNA
ccccacttgagtcatt

SEQ ID NO: 1500 - DNA, 16 bp, synthetic construct
  misc_feature 1..16: note = Synthetic oligonucleotide
  source 1..16: mol_type = other DNA
cagagcgggaggtgac

SEQ ID NO: 1501 - DNA, 16 bp, synthetic construct
  misc_feature 1..16: note = Synthetic oligonucleotide
  source 1..16: mol_type = other DNA
atcaggcccgatacat

SEQ ID NO: 1502 - DNA, 16 bp, synthetic construct
  misc_feature 1..16: note = Synthetic oligonucleotide
  source 1..16: mol_type = other DNA
ctcaagacaacatggg

SEQ ID NO: 1503 - DNA, 16 bp, synthetic construct
  misc_feature 1..16: note = Synthetic oligonucleotide
  source 1..16: mol_type = other DNA
cccttagggaggccct

SEQ ID NO: 1504 - DNA, 16 bp, synthetic construct
  misc_feature 1..16: note = Synthetic oligonucleotide
  source 1..16: mol_type = other DNA
cttactcaattaactc

SEQ ID NO: 1505 - DNA, 16 bp, synthetic construct
  misc_feature 1..16: note = Synthetic oligonucleotide
  source 1..16: mol_type = other DNA
actttttcaccatagc

SEQ ID NO: 1506 - DNA, 16 bp, synthetic construct
  misc_feature 1..16: note = Synthetic oligonucleotide
  source 1..16: mol_type = other DNA
tgtccttactgcagtt

SEQ ID NO: 1507 - DNA, 16 bp, synthetic construct
  misc_feature 1..16: note = Synthetic oligonucleotide
  source 1..16: mol_type = other DNA
ccagggattttccaac

SEQ ID NO: 1508 - DNA, 16 bp, synthetic construct
  misc_feature 1..16: note = Synthetic oligonucleotide
  source 1..16: mol_type = other DNA
ggtctcacctgtattc

SEQ ID NO: 1509 - DNA, 16 bp, synthetic construct
  misc_feature 1..16: note = Synthetic oligonucleotide
  source 1..16: mol_type = other DNA
tttgcactaaaagctg

SEQ ID NO: 1510 - DNA, 16 bp, synthetic construct
  misc_feature 1..16: note = Synthetic oligonucleotide
  source 1..16: mol_type = other DNA
cccagaaatccttatg

SEQ ID NO: 1511 - DNA, 16 bp, synthetic construct
  misc_feature 1..16: note = Synthetic oligonucleotide
  source 1..16: mol_type = other DNA
cgttccatgtatgccc

SEQ ID NO: 1512 - DNA, 16 bp, synthetic construct
  misc_feature 1..16: note = Synthetic oligonucleotide
  source 1..16: mol_type = other DNA
cacactcaatcatacc

SEQ ID NO: 1513 - DNA, 16 bp, synthetic construct
  misc_feature 1..16: note = Synthetic oligonucleotide
  source 1..16: mol_type = other DNA
ggccaattcagctaag

SEQ ID NO: 1514 - DNA, 16 bp, synthetic construct
  misc_feature 1..16: note = Synthetic oligonucleotide
  source 1..16: mol_type = other DNA
cctacgaggcctttag

SEQ ID NO: 1515 - DNA, 16 bp, synthetic construct
  misc_feature 1..16: note = Synthetic oligonucleotide
  source 1..16: mol_type = other DNA
acctctggcactaaat

SEQ ID NO: 1516 - DNA, 16 bp, synthetic construct
  misc_feature 1..16: note = Synthetic oligonucleotide
  source 1..16: mol_type = other DNA
ttggctgggcgagcga

SEQ ID NO: 1517 - DNA, 16 bp, synthetic construct
  misc_feature 1..16: note = Synthetic oligonucleotide
  source 1..16: mol_type = other DNA
gctgacttggttgccg

SEQ ID NO: 1518 - DNA, 16 bp, synthetic construct
  misc_feature 1..16: note = Synthetic oligonucleotide
  source 1..16: mol_type = other DNA
tgggcctgttattaaa

SEQ ID NO: 1519 - DNA, 16 bp, synthetic construct
  misc_feature 1..16: note = Synthetic oligonucleotide
  source 1..16: mol_type = other DNA
ctgatccttgaggcac

SEQ ID NO: 1520 - DNA, 16 bp, synthetic construct
  misc_feature 1..16: note = Synthetic oligonucleotide
  source 1..16: mol_type = other DNA
caactaccatgcaaag

SEQ ID NO: 1521 - DNA, 16 bp, synthetic construct
  misc_feature 1..16: note = Synthetic oligonucleotide
  source 1..16: mol_type = other DNA
aactccttatgttttg

SEQ ID NO: 1522 - DNA, 16 bp, synthetic construct
  misc_feature 1..16: note = Synthetic oligonucleotide
  source 1..16: mol_type = other DNA
tccagacagcgagagt

SEQ ID NO: 1523 - DNA, 16 bp, synthetic construct
  misc_feature 1..16: note = Synthetic oligonucleotide
  source 1..16: mol_type = other DNA
ggcatgatgtaaaatt

SEQ ID NO: 1524 - DNA, 16 bp, synthetic construct
  misc_feature 1..16: note = Synthetic oligonucleotide
  source 1..16: mol_type = other DNA
gcaggattactcctga

SEQ ID NO: 1525 - DNA, 16 bp, synthetic construct
  misc_feature 1..16: note = Synthetic oligonucleotide
  source 1..16: mol_type = other DNA
acagtgaaacaagcaa

SEQ ID NO: 1526 - DNA, 16 bp, synthetic construct
  misc_feature 1..16: note = Synthetic oligonucleotide
  source 1..16: mol_type = other DNA
tggtatattcctgacc

SEQ ID NO: 1527 - DNA, 16 bp, synthetic construct
  misc_feature 1..16: note = Synthetic oligonucleotide
  source 1..16: mol_type = other DNA
ccttaatgtaaattcc

SEQ ID NO: 1528 - DNA, 16 bp, synthetic construct
  misc_feature 1..16: note = Synthetic oligonucleotide
  source 1..16: mol_type = other DNA
atgtgaatatcaacac

SEQ ID NO: 1529 - DNA, 16 bp, synthetic construct
  misc_feature 1..16: note = Synthetic oligonucleotide
  source 1..16: mol_type = other DNA
cccagtgatcacttcc

SEQ ID NO: 1530 - DNA, 16 bp, synthetic construct
  misc_feature 1..16: note = Synthetic oligonucleotide
  source 1..16: mol_type = other DNA
gaacattgaaacacca

SEQ ID NO: 1531 - DNA, 16 bp, synthetic construct
  misc_feature 1..16: note = Synthetic oligonucleotide
  source 1..16: mol_type = other DNA
cagcttccataagcca

SEQ ID NO: 1532 - DNA, 16 bp, synthetic construct
  misc_feature 1..16: note = Synthetic oligonucleotide
  source 1..16: mol_type = other DNA
gagatcacaagggtag

SEQ ID NO: 1533 - DNA, 16 bp, synthetic construct
  misc_feature 1..16: note = Synthetic oligonucleotide
  source 1..16: mol_type = other DNA
atagagggaattgtgt

SEQ ID NO: 1534 - DNA, 16 bp, synthetic construct
  misc_feature 1..16: note = Synthetic oligonucleotide
  source 1..16: mol_type = other DNA
agctgtgatgtgggac

SEQ ID NO: 1535 - DNA, 16 bp, synthetic construct
  misc_feature 1..16: note = Synthetic oligonucleotide
  source 1..16: mol_type = other DNA
gttggaggaaagtgtg

SEQ ID NO: 1536 - DNA, 16 bp, synthetic construct
  misc_feature 1..16: note = Synthetic oligonucleotide
  source 1..16: mol_type = other DNA
tctgacataagcccag

SEQ ID NO: 1537 - DNA, 16 bp, synthetic construct
  misc_feature 1..16: note = Synthetic oligonucleotide
  source 1..16: mol_type = other DNA
agaaccacctatataa

SEQ ID NO: 1538 - DNA, 16 bp, synthetic construct
  misc_feature 1..16: note = Synthetic oligonucleotide
  source 1..16: mol_type = other DNA
atataccgaggaattc

SEQ ID NO: 1539 - DNA, 16 bp, synthetic construct
  misc_feature 1..16: note = Synthetic oligonucleotide
  source 1..16: mol_type = other DNA
atcccacctccagtta

SEQ ID NO: 1540 - DNA, 16 bp, synthetic construct
  misc_feature 1..16: note = Synthetic oligonucleotide
  source 1..16: mol_type = other DNA
ccaaggaaaagtgcac

SEQ ID NO: 1541 - DNA, 16 bp, synthetic construct
  misc_feature 1..16: note = Synthetic oligonucleotide
  source 1..16: mol_type = other DNA
ttgaggatctccagta

SEQ ID NO: 1542 - DNA, 16 bp, synthetic construct
  misc_feature 1..16: note = Synthetic oligonucleotide
  source 1..16: mol_type = other DNA
gtgccagtttttgtct

SEQ ID NO: 1543 - DNA, 16 bp, synthetic construct
  misc_feature 1..16: note = Synthetic oligonucleotide
  source 1..16: mol_type = other DNA
gccttcttatgttatc

SEQ ID NO: 1544 - DNA, 16 bp, synthetic construct
  misc_feature 1..16: note = Synthetic oligonucleotide
  source 1..16: mol_type = other DNA
cctttgtggaccttct

SEQ ID NO: 1545 - DNA, 16 bp, synthetic construct
  misc_feature 1..16: note = Synthetic oligonucleotide
  source 1..16: mol_type = other DNA
cccatgccgacgaggg

SEQ ID NO: 1546 - DNA, 16 bp, synthetic construct
  misc_feature 1..16: note = Synthetic oligonucleotide
  source 1..16: mol_type = other DNA
ggctgtgattcccaac

SEQ ID NO: 1547 - DNA, 16 bp, synthetic construct
  misc_feature 1..16: note = Synthetic oligonucleotide
  source 1..16: mol_type = other DNA
ccgtagtccatggtac

SEQ ID NO: 1548 - DNA, 16 bp, synthetic construct
  misc_feature 1..16: note = Synthetic oligonucleotide
  source 1..16: mol_type = other DNA
ttgtcaaggcttttga

SEQ ID NO: 1549 - DNA, 16 bp, synthetic construct
  misc_feature 1..16: note = Synthetic oligonucleotide
  source 1..16: mol_type = other DNA
cggatgtccttcccaa

SEQ ID NO: 1550 - DNA, 16 bp, synthetic construct
  misc_feature 1..16: note = Synthetic oligonucleotide
  source 1..16: mol_type = other DNA
tggctcagtgacccgg

SEQ ID NO: 1551 - DNA, 16 bp, synthetic construct
  misc_feature 1..16: note = Synthetic oligonucleotide
  source 1..16: mol_type = other DNA
ttcattaaccctctcc

SEQ ID NO: 1552 - DNA, 16 bp, synthetic construct
  misc_feature 1..16: note = Synthetic oligonucleotide
  source 1..16: mol_type = other DNA
aggtagactacatcca

SEQ ID NO: 1553 - DNA, 16 bp, synthetic construct
  misc_feature 1..16: note = Synthetic oligonucleotide
  source 1..16: mol_type = other DNA
ttggtccgcctgcaga

SEQ ID NO: 1554 - DNA, 16 bp, synthetic construct
  misc_feature 1..16: note = Synthetic oligonucleotide
  source 1..16: mol_type = other DNA
ttgggtcaaaagcgat

SEQ ID NO: 1555 - DNA, 16 bp, synthetic construct
  misc_feature 1..16: note = Synthetic oligonucleotide
  source 1..16: mol_type = other DNA
tcagctatggaaatgc

SEQ ID NO: 1556 - DNA, 16 bp, synthetic construct
  misc_feature 1..16: note = Synthetic oligonucleotide
  source 1..16: mol_type = other DNA
ctaaagtaaactgctt

SEQ ID NO: 1557 - DNA, 16 bp, synthetic construct
  misc_feature 1..16: note = Synthetic oligonucleotide
  source 1..16: mol_type = other DNA
gttccttcaagcctcc

SEQ ID NO: 1558 - DNA, 16 bp, synthetic construct
  misc_feature 1..16: note = Synthetic oligonucleotide
  source 1..16: mol_type = other DNA
cttcggaggacattga

SEQ ID NO: 1559 - DNA, 16 bp, synthetic construct
  misc_feature 1..16: note = Synthetic oligonucleotide
  source 1..16: mol_type = other DNA
gaagccgctgcctgac

SEQ ID NO: 1560 - DNA, 16 bp, synthetic construct
  misc_feature 1..16: note = Synthetic oligonucleotide
  source 1..16: mol_type = other DNA
cccttcagtgttcaag

SEQ ID NO: 1561 - DNA, 16 bp, synthetic construct
  misc_feature 1..16: note = Synthetic oligonucleotide
  source 1..16: mol_type = other DNA
tttacttaccgggtaa

SEQ ID NO: 1562 - DNA, 16 bp, synthetic construct
  misc_feature 1..16: note = Synthetic oligonucleotide
  source 1..16: mol_type = other DNA
atcctgggcggcgaca

SEQ ID NO: 1563 - DNA, 16 bp, synthetic construct
  misc_feature 1..16: note = Synthetic oligonucleotide
  source 1..16: mol_type = other DNA
aggcaccattctgcaa

SEQ ID NO: 1564 - DNA, 16 bp, synthetic construct
  misc_feature 1..16: note = Synthetic oligonucleotide
  source 1..16: mol_type = other DNA
tgagctgtttccccaa

SEQ ID NO: 1565 - DNA, 16 bp, synthetic construct
  misc_feature 1..16: note = Synthetic oligonucleotide
  source 1..16: mol_type = other DNA
ccagtccaattgtgca

SEQ ID NO: 1566 - DNA, 16 bp, synthetic construct
  misc_feature 1..16: note = Synthetic oligonucleotide
  source 1..16: mol_type = other DNA
tgttcactgtgtgatc

SEQ ID NO: 1567 - DNA, 16 bp, synthetic construct
  misc_feature 1..16: note = Synthetic oligonucleotide
  source 1..16: mol_type = other DNA
gcctcttacatgtgtc

SEQ ID NO: 1568 - DNA, 16 bp, synthetic construct
  misc_feature 1..16: note = Synthetic oligonucleotide
  source 1..16: mol_type = other DNA
tgtgagccaccagtgg

SEQ ID NO: 1569 - DNA, 16 bp, synthetic construct
  misc_feature 1..16: note = Synthetic oligonucleotide
  source 1..16: mol_type = other DNA
gggccgtgtcacccta

SEQ ID NO: 1570 - DNA, 16 bp, synthetic construct
  misc_feature 1..16: note = Synthetic oligonucleotide
  source 1..16: mol_type = other DNA
cccccccgctgattcc

SEQ ID NO: 1571 - DNA, 16 bp, synthetic construct
  misc_feature 1..16: note = Synthetic oligonucleotide
  source 1..16: mol_type = other DNA
accagcctcaggtgga

SEQ ID NO: 1572 - DNA, 16 bp, synthetic construct
  misc_feature 1..16: note = Synthetic oligonucleotide
  source 1..16: mol_type = other DNA
caaaggacagaccggg

SEQ ID NO: 1573 - DNA, 16 bp, synthetic construct
  misc_feature 1..16: note = Synthetic oligonucleotide
  source 1..16: mol_type = other DNA
aggccaggtagccgtg

SEQ ID NO: 1574 - DNA, 16 bp, synthetic construct
  misc_feature 1..16: note = Synthetic oligonucleotide
  source 1..16: mol_type = other DNA
ttagatgactgaactc

SEQ ID NO: 1575 - DNA, 16 bp, synthetic construct
  misc_feature 1..16: note = Synthetic oligonucleotide
  source 1..16: mol_type = other DNA
agcctcctccagtttg

SEQ ID NO: 1576 - DNA, 16 bp, synthetic construct
  misc_feature 1..16: note = Synthetic oligonucleotide
  source 1..16: mol_type = other DNA
cgataaaccttgtctc

SEQ ID NO: 1577 - DNA, 16 bp, synthetic construct
  misc_feature 1..16: note = Synthetic oligonucleotide
  source 1..16: mol_type = other DNA
cagttttgtaagtgca

SEQ ID NO: 1578 - DNA, 16 bp, synthetic construct
  misc_feature 1..16: note = Synthetic oligonucleotide
  source 1..16: mol_type = other DNA
cggagacctccctaaa

SEQ ID NO: 1579 - DNA, 16 bp, synthetic construct
  misc_feature 1..16: note = Synthetic oligonucleotide
  source 1..16: mol_type = other DNA
gggcaaggctaagttc

SEQ ID NO: 1580 - DNA, 16 bp, synthetic construct
  misc_feature 1..16: note = Synthetic oligonucleotide
  source 1..16: mol_type = other DNA
ccagcaaagacaagaa

SEQ ID NO: 1581 - DNA, 16 bp, synthetic construct
  misc_feature 1..16: note = Synthetic oligonucleotide
  source 1..16: mol_type = other DNA
ggtacaaaactgcatt

SEQ ID NO: 1582 - DNA, 16 bp, synthetic construct
  misc_feature 1..16: note = Synthetic oligonucleotide
  source 1..16: mol_type = other DNA
tcactaaaccccacac

SEQ ID NO: 1583 - DNA, 16 bp, synthetic construct
  misc_feature 1..16: note = Synthetic oligonucleotide
  source 1..16: mol_type = other DNA
cagtgagatccaactc

SEQ ID NO: 1584 - DNA, 16 bp, synthetic construct
  misc_feature 1..16: note = Synthetic oligonucleotide
  source 1..16: mol_type = other DNA
atgggcccacaggatc

SEQ ID NO: 1585 - DNA, 16 bp, synthetic construct
  misc_feature 1..16: note = Synthetic oligonucleotide
  source 1..16: mol_type = other DNA
tacttctgttagatac

SEQ ID NO: 1586 - DNA, 16 bp, synthetic construct
  misc_feature 1..16: note = Synthetic oligonucleotide
  source 1..16: mol_type = other DNA
tgtaaccccctgaaac

SEQ ID NO: 1587 - DNA, 16 bp, synthetic construct
  misc_feature 1..16: note = Synthetic oligonucleotide
  source 1..16: mol_type = other DNA
tgaaacattcctggac

SEQ ID NO: 1588 - DNA, 16 bp, synthetic construct
  misc_feature 1..16: note = Synthetic oligonucleotide
  source 1..16: mol_type = other DNA
acccaggtttggatgg

SEQ ID NO: 1589 - DNA, 16 bp, synthetic construct
  misc_feature 1..16: note = Synthetic oligonucleotide
  source 1..16: mol_type = other DNA
gtggcaactctgtaag

SEQ ID NO: 1590 - DNA, 16 bp, synthetic construct
  misc_feature 1..16: note = Synthetic oligonucleotide
  source 1..16: mol_type = other DNA
ggctgagtgctctcgg

SEQ ID NO: 1591 - DNA, 16 bp, synthetic construct
  misc_feature 1..16: note = Synthetic oligonucleotide
  source 1..16: mol_type = other DNA
agggtacacggctctc

SEQ ID NO: 1592 - DNA, 16 bp, synthetic construct
  misc_feature 1..16: note = Synthetic oligonucleotide
  source 1..16: mol_type = other DNA
ggtcttgggcactctc

SEQ ID NO: 1593 - DNA, 16 bp, synthetic construct
  misc_feature 1..16: note = Synthetic oligonucleotide
  source 1..16: mol_type = other DNA
ataatgtctcaaactc

SEQ ID NO: 1594 - DNA, 16 bp, synthetic construct
  misc_feature 1..16: note = Synthetic oligonucleotide
  source 1..16: mol_type = other DNA
caccgcccaaaaccat

SEQ ID NO: 1595 - DNA, 16 bp, synthetic construct
  misc_feature 1..16: note = Synthetic oligonucleotide
  source 1..16: mol_type = other DNA
cgtgcacacacaagag

SEQ ID NO: 1596 - DNA, 16 bp, synthetic construct
  misc_feature 1..16: note = Synthetic oligonucleotide
  source 1..16: mol_type = other DNA
gggaattatggaattg

SEQ ID NO: 1597 - DNA, 16 bp, synthetic construct
  misc_feature 1..16: note = Synthetic oligonucleotide
  source 1..16: mol_type = other DNA
gaactcaagtcagtac

SEQ ID NO: 1598 - DNA, 16 bp, synthetic construct
  misc_feature 1..16: note = Synthetic oligonucleotide
  source 1..16: mol_type = other DNA
ctccctgtaatcacac

SEQ ID NO: 1599 - DNA, 16 bp, synthetic construct
  misc_feature 1..16: note = Synthetic oligonucleotide
  source 1..16: mol_type = other DNA
taggcattcagaattt

SEQ ID NO: 1600 - DNA, 16 bp, synthetic construct
  misc_feature 1..16: note = Synthetic oligonucleotide
  source 1..16: mol_type = other DNA
attattggttcaaaag

SEQ ID NO: 1601 - DNA, 16 bp, synthetic construct
  misc_feature 1..16: note = Synthetic oligonucleotide
  source 1..16: mol_type = other DNA
cctgttgggtcaaaca

SEQ ID NO: 1602 - DNA, 16 bp, synthetic construct
  misc_feature 1..16: note = Synthetic oligonucleotide
  source 1..16: mol_type = other DNA
ccaacatgaagtgagc

SEQ ID NO: 1603 - DNA, 16 bp, synthetic construct
  misc_feature 1..16: note = Synthetic oligonucleotide
  source 1..16: mol_type = other DNA
cttttggcaccttcac

SEQ ID NO: 1604 - DNA, 16 bp, synthetic construct
  misc_feature 1..16: note = Synthetic oligonucleotide
  source 1..16: mol_type = other DNA
tattagagggctagtg

SEQ ID NO: 1605 - DNA, 16 bp, synthetic construct
  misc_feature 1..16: note = Synthetic oligonucleotide
  source 1..16: mol_type = other DNA
taaactcaggtgacta

SEQ ID NO: 1606 - DNA, 16 bp, synthetic construct
  misc_feature 1..16: note = Synthetic oligonucleotide
  source 1..16: mol_type = other DNA
atggagtcattagtgc

SEQ ID NO: 1607 - DNA, 16 bp, synthetic construct
  misc_feature 1..16: note = Synthetic oligonucleotide
  source 1..16: mol_type = other DNA
taacagccattgcata

SEQ ID NO: 1608 - DNA, 16 bp, synthetic construct
  misc_feature 1..16: note = Synthetic oligonucleotide
  source 1..16: mol_type = other DNA
gatataccgaggaatt

SEQ ID NO: 1609 - DNA, 16 bp, synthetic construct
  misc_feature 1..16: note = Synthetic oligonucleotide
  source 1..16: mol_type = other DNA
gatcccacctccagtt

SEQ ID NO: 1610 - DNA, 16 bp, synthetic construct
  misc_feature 1..16: note = Synthetic oligonucleotide
  source 1..16: mol_type = other DNA
caccaaggaaaagtgc

SEQ ID NO: 1611 - DNA, 16 bp, synthetic construct
  misc_feature 1..16: note = Synthetic oligonucleotide
  source 1..16: mol_type = other DNA
actttgaggatctcca

SEQ ID NO: 1612 - DNA, 16 bp, synthetic construct
  misc_feature 1..16: note = Synthetic oligonucleotide
  source 1..16: mol_type = other DNA
cgtgccagtttttgtc

SEQ ID NO: 1613 - DNA, 16 bp, synthetic construct
  misc_feature 1..16: note = Synthetic oligonucleotide
  source 1..16: mol_type = other DNA
agccttcttatgttat

SEQ ID NO: 1614 - DNA, 16 bp, synthetic construct
  misc_feature 1..16: note = Synthetic oligonucleotide
  source 1..16: mol_type = other DNA
gcctttgtggaccttc

SEQ ID NO: 1615 - DNA, 16 bp, synthetic construct
  misc_feature 1..16: note = Synthetic oligonucleotide
  source 1..16: mol_type = other DNA
acccatgccgacgagg

SEQ ID NO: 1616 - DNA, 16 bp, synthetic construct
  misc_feature 1..16: note = Synthetic oligonucleotide
  source 1..16: mol_type = other DNA
cggctgtgattcccaa

SEQ ID NO: 1617 - DNA, 16 bp, synthetic construct
  misc_feature 1..16: note = Synthetic oligonucleotide
  source 1..16: mol_type = other DNA
tccgtagtccatggta

SEQ ID NO: 1618 - DNA, 16 bp, synthetic construct
  misc_feature 1..16: note = Synthetic oligonucleotide
  source 1..16: mol_type = other DNA
tcaatttgtcaaggct

SEQ ID NO: 1619 - DNA, 16 bp, synthetic construct
  misc_feature 1..16: note = Synthetic oligonucleotide
  source 1..16: mol_type = other DNA
acggatgtccttccca

SEQ ID NO: 1620 - DNA, 16 bp, synthetic construct
  misc_feature 1..16: note = Synthetic oligonucleotide
  source 1..16: mol_type = other DNA
ttggctcagtgacccg

SEQ ID NO: 1621 - DNA, 16 bp, synthetic construct
  misc_feature 1..16: note = Synthetic oligonucleotide
  source 1..16: mol_type = other DNA
ggttcattaaccctct

SEQ ID NO: 1622 - DNA, 16 bp, synthetic construct
  misc_feature 1..16: note = Synthetic oligonucleotide
  source 1..16: mol_type = other DNA
gaggtagactacatcc

SEQ ID NO: 1623 - DNA, 16 bp, synthetic construct
  misc_feature 1..16: note = Synthetic oligonucleotide
  source 1..16: mol_type = other DNA
cttggtccgcctgcag

SEQ ID NO: 1624 - DNA, 16 bp, synthetic construct
  misc_feature 1..16: note = Synthetic oligonucleotide
  source 1..16: mol_type = other DNA
tttgggtcaaaagcga

SEQ ID NO: 1625 - DNA, 16 bp, synthetic construct
  misc_feature 1..16: note = Synthetic oligonucleotide
  source 1..16: mol_type = other DNA
gctcagctatggaaat

SEQ ID NO: 1626 - DNA, 16 bp, synthetic construct
  misc_feature 1..16: note = Synthetic oligonucleotide
  source 1..16: mol_type = other DNA
gtctaaagtaaactgc

SEQ ID NO: 1627 - DNA, 16 bp, synthetic construct
  misc_feature 1..16: note = Synthetic oligonucleotide
  source 1..16: mol_type = other DNA
tggttccttcaagcct

SEQ ID NO: 1628 - DNA, 16 bp, synthetic construct
  misc_feature 1..16: note = Synthetic oligonucleotide
  source 1..16: mol_type = other DNA
tcttcggaggacattg

SEQ ID NO: 1629 - DNA, 16 bp, synthetic construct
  misc_feature 1..16: note = Synthetic oligonucleotide
  source 1..16: mol_type = other DNA
ggaagccgctgcctga

SEQ ID NO: 1630 - DNA, 16 bp, synthetic construct
  misc_feature 1..16: note = Synthetic oligonucleotide
  source 1..16: mol_type = other DNA
gcccttcagtgttcaa

SEQ ID NO: 1631 - DNA, 16 bp, synthetic construct
  misc_feature 1..16: note = Synthetic oligonucleotide
  source 1..16: mol_type = other DNA
gtttacttaccgggta

SEQ ID NO: 1632 - DNA, 16 bp, synthetic construct
  misc_feature 1..16: note = Synthetic oligonucleotide
  source 1..16: mol_type = other DNA
aatcctgggcggcgac

SEQ ID NO: 1633 - DNA, 16 bp, synthetic construct
  misc_feature 1..16: note = Synthetic oligonucleotide
  source 1..16: mol_type = other DNA
acaggcaccattctgc

SEQ ID NO: 1634 - DNA, 16 bp, synthetic construct
  misc_feature 1..16: note = Synthetic oligonucleotide
  source 1..16: mol_type = other DNA
ccatctgagctgtttc

SEQ ID NO: 1635 - DNA, 16 bp, synthetic construct
  misc_feature 1..16: note = Synthetic oligonucleotide
  source 1..16: mol_type = other DNA
cccagtccaattgtgc

SEQ ID NO: 1636 - DNA, 16 bp, synthetic construct
  misc_feature 1..16: note = Synthetic oligonucleotide
  source 1..16: mol_type = other DNA
ttgctgtaagggacaa

SEQ ID NO: 1637 - DNA, 16 bp, synthetic construct
  misc_feature 1..16: note = Synthetic oligonucleotide
  source 1..16: mol_type = other DNA
cagagcctcttacatg

SEQ ID NO: 1638 - DNA, 16 bp, synthetic construct
  misc_feature 1..16: note = Synthetic oligonucleotide
  source 1..16: mol_type = other DNA
atgtgagccaccagtg

SEQ ID NO: 1639 - DNA, 16 bp, synthetic construct
  misc_feature 1..16: note = Synthetic oligonucleotide
  source 1..16: mol_type = other DNA
tgggccgtgtcaccct

SEQ ID NO: 1640 - DNA, 16 bp, synthetic construct
  misc_feature 1..16: note = Synthetic oligonucleotide
  source 1..16: mol_type = other DNA
ccccccccgctgattc

SEQ ID NO: 1641 - DNA, 16 bp, synthetic construct
  misc_feature 1..16: note = Synthetic oligonucleotide
  source 1..16: mol_type = other DNA
ggaccagcctcaggtg

SEQ ID NO: 1642 - DNA, 16 bp, synthetic construct
  misc_feature 1..16: note = Synthetic oligonucleotide
  source 1..16: mol_type = other DNA
gcaaaggacagaccgg

SEQ ID NO: 1643 - DNA, 16 bp, synthetic construct
  misc_feature 1..16: note = Synthetic oligonucleotide
  source 1..16: mol_type = other DNA
caggccaggtagccgt

SEQ ID NO: 1644 - DNA, 16 bp, synthetic construct
  misc_feature 1..16: note = Synthetic oligonucleotide
  source 1..16: mol_type = other DNA
tttagatgactgaact

SEQ ID NO: 1645 - DNA, 16 bp, synthetic construct
  misc_feature 1..16: note = Synthetic oligonucleotide
  source 1..16: mol_type = other DNA
aagcctcctccagttt

SEQ ID NO: 1646 - DNA, 16 bp, synthetic construct
  misc_feature 1..16: note = Synthetic oligonucleotide
  source 1..16: mol_type = other DNA
ccgataaaccttgtct

SEQ ID NO: 1647 - DNA, 16 bp, synthetic construct
  misc_feature 1..16: note = Synthetic oligonucleotide
  source 1..16: mol_type = other DNA
gcagttttgtaagtgc

SEQ ID NO: 1648 - DNA, 16 bp, synthetic construct
  misc_feature 1..16: note = Synthetic oligonucleotide
  source 1..16: mol_type = other DNA
tcggagacctccctaa

SEQ ID NO: 1649 - DNA, 16 bp, synthetic construct
  misc_feature 1..16: note = Synthetic oligonucleotide
  source 1..16: mol_type = other DNA
tgggcaaggctaagtt

SEQ ID NO: 1650 - DNA, 16 bp, synthetic construct
  misc_feature 1..16: note = Synthetic oligonucleotide
  source 1..16: mol_type = other DNA
actccacaccttaatt

SEQ ID NO: 1651 - DNA, 16 bp, synthetic construct
  misc_feature 1..16: note = Synthetic oligonucleotide
  source 1..16: mol_type = other DNA
tggtacaaaactgcat

SEQ ID NO: 1652 - DNA, 16 bp, synthetic construct
  misc_feature 1..16: note = Synthetic oligonucleotide
  source 1..16: mol_type = other DNA
ctcactaaaccccaca

SEQ ID NO: 1653 - DNA, 16 bp, synthetic construct
  misc_feature 1..16: note = Synthetic oligonucleotide
  source 1..16: mol_type = other DNA
ccagtgagatccaact

SEQ ID NO: 1654 - DNA, 16 bp, synthetic construct
  misc_feature 1..16: note = Synthetic oligonucleotide
  source 1..16: mol_type = other DNA
gatgggcccacaggat

SEQ ID NO: 1655 - DNA, 16 bp, synthetic construct
  misc_feature 1..16: note = Synthetic oligonucleotide
  source 1..16: mol_type = other DNA
gtacttctgttagata

SEQ ID NO: 1656 - DNA, 16 bp, synthetic construct
  misc_feature 1..16: note = Synthetic oligonucleotide
  source 1..16: mol_type = other DNA
gctgtaaccccctgaa

SEQ ID NO: 1657 - DNA, 16 bp, synthetic construct
  misc_feature 1..16: note = Synthetic oligonucleotide
  source 1..16: mol_type = other DNA
gccctgaaacattcct

SEQ ID NO: 1658 - DNA, 16 bp, synthetic construct
  misc_feature 1..16: note = Synthetic oligonucleotide
  source 1..16: mol_type = other DNA
aacccaggtttggatg

SEQ ID NO: 1659 - DNA, 16 bp, synthetic construct
  misc_feature 1..16: note = Synthetic oligonucleotide
  source 1..16: mol_type = other DNA
cgtggcaactctgtaa

SEQ ID NO: 1660 - DNA, 16 bp, synthetic construct
  misc_feature 1..16: note = Synthetic oligonucleotide
  source 1..16: mol_type = other DNA
tcggctgagtgctctc

SEQ ID NO: 1661 - DNA, 16 bp, synthetic construct
  misc_feature 1..16: note = Synthetic oligonucleotide
  source 1..16: mol_type = other DNA
cagggtacacggctct

SEQ ID NO: 1662 - DNA, 16 bp, synthetic construct
  misc_feature 1..16: note = Synthetic oligonucleotide
  source 1..16: mol_type = other DNA
tggtcttgggcactct

SEQ ID NO: 1663 - DNA, 16 bp, synthetic construct
  misc_feature 1..16: note = Synthetic oligonucleotide
  source 1..16: mol_type = other DNA
atagcttacctgtggg

SEQ ID NO: 1664 - DNA, 16 bp, synthetic construct
  misc_feature 1..16: note = Synthetic oligonucleotide
  source 1..16: mol_type = other DNA
tcaccgcccaaaacca

SEQ ID NO: 1665 - DNA, 16 bp, synthetic construct
  misc_feature 1..16: note = Synthetic oligonucleotide
  source 1..16: mol_type = other DNA
ccgtgcacacacaaga

SEQ ID NO: 1666 - DNA, 16 bp, synthetic construct
  misc_feature 1..16: note = Synthetic oligonucleotide
  source 1..16: mol_type = other DNA
gatctgggaattatgg

SEQ ID NO: 1667 - DNA, 16 bp, synthetic construct
  misc_feature 1..16: note = Synthetic oligonucleotide
  source 1..16: mol_type = other DNA
agaactcaagtcagta

SEQ ID NO: 1668 - DNA, 16 bp, synthetic construct
  misc_feature 1..16: note = Synthetic oligonucleotide
  source 1..16: mol_type = other DNA
gctccctgtaatcaca

SEQ ID NO: 1669 - DNA, 16 bp, synthetic construct
  misc_feature 1..16: note = Synthetic oligonucleotide
  source 1..16: mol_type = other DNA
tgtttaggcattcaga

SEQ ID NO: 1670 - DNA, 16 bp, synthetic construct
  misc_feature 1..16: note = Synthetic oligonucleotide
  source 1..16: mol_type = other DNA
tgaaattattggttca

SEQ ID NO: 1671 - DNA, 16 bp, synthetic construct
  misc_feature 1..16: note = Synthetic oligonucleotide
  source 1..16: mol_type = other DNA
gcctgttgggtcaaac

SEQ ID NO: 1672 - DNA, 16 bp, synthetic construct
  misc_feature 1..16: note = Synthetic oligonucleotide
  source 1..16: mol_type = other DNA
accaacatgaagtgag

SEQ ID NO: 1673 - DNA, 16 bp, synthetic construct
  misc_feature 1..16: note = Synthetic oligonucleotide
  source 1..16: mol_type = other DNA
ccttttggcaccttca

SEQ ID NO: 1674 - DNA, 16 bp, synthetic construct
  misc_feature 1..16: note = Synthetic oligonucleotide
  source 1..16: mol_type = other DNA
ctattagagggctagt

SEQ ID NO: 1675 - DNA, 16 bp, synthetic construct
  misc_feature 1..16: note = Synthetic oligonucleotide
  source 1..16: mol_type = other DNA
tttaaactcaggtgac

SEQ ID NO: 1676 - DNA, 16 bp, synthetic construct
  misc_feature 1..16: note = Synthetic oligonucleotide
  source 1..16: mol_type = other DNA
tatggagtcattagtg

SEQ ID NO: 1677 - DNA, 16 bp, synthetic construct
  misc_feature 1..16: note = Synthetic oligonucleotide
  source 1..16: mol_type = other DNA
ataacagccattgcat

SEQ ID NO: 1678 - DNA, 16 bp, synthetic construct
  misc_feature 1..16: note = Synthetic oligonucleotide
  source 1..16: mol_type = other DNA
gttttgttgcaccctc

SEQ ID NO: 1679 - DNA, 16 bp, synthetic construct
  misc_feature 1..16: note = Synthetic oligonucleotide
  source 1..16: mol_type = other DNA
attctgtgtgctcact

SEQ ID NO: 1680 - DNA, 16 bp, synthetic construct
  misc_feature 1..16: note = Synthetic oligonucleotide
  source 1..16: mol_type = other DNA
cagattctgtgtgctc

SEQ ID NO: 1681 - DNA, 16 bp, synthetic construct
  misc_feature 1..16: note = Synthetic oligonucleotide
  source 1..16: mol_type = other DNA
gtcagcaggagtagca

SEQ ID NO: 1682 - DNA, 16 bp, synthetic construct
  misc_feature 1..16: note = Synthetic oligonucleotide
  source 1..16: mol_type = other DNA
cagtcagcaggagtag

SEQ ID NO: 1683 - DNA, 16 bp, synthetic construct
  misc_feature 1..16: note = Synthetic oligonucleotide
  source 1..16: mol_type = other DNA
tcagtcagcaggagta

SEQ ID NO: 1684 - DNA, 16 bp, synthetic construct
  misc_feature 1..16: note = Synthetic oligonucleotide
  source 1..16: mol_type = other DNA
ctcattatcagtcagc

SEQ ID NO: 1685 - DNA, 16 bp, synthetic construct
  misc_feature 1..16: note = Synthetic oligonucleotide
  source 1..16: mol_type = other DNA
caggcctcattatcag

SEQ ID NO: 1686 - DNA, 16 bp, synthetic construct
  misc_feature 1..16: note = Synthetic oligonucleotide
  source 1..16: mol_type = other DNA
ccaggcctcattatca

SEQ ID NO: 1687 - DNA, 16 bp, synthetic construct
  misc_feature 1..16: note = Synthetic oligonucleotide
  source 1..16: mol_type = other DNA
tccaggcctcattatc

SEQ ID NO: 1688 - DNA, 16 bp, synthetic construct
  misc_feature 1..16: note = Synthetic oligonucleotide
  source 1..16: mol_type = other DNA
ttccaggcctcattat

SEQ ID NO: 1689 - DNA, 16 bp, synthetic construct
  misc_feature 1..16: note = Synthetic oligonucleotide
  source 1..16: mol_type = other DNA
gttccaggcctcatta

SEQ ID NO: 1690 - DNA, 16 bp, synthetic construct
  misc_feature 1..16: note = Synthetic oligonucleotide
  source 1..16: mol_type = other DNA
cgttccaggcctcatt

SEQ ID NO: 1691 - DNA, 16 bp, synthetic construct
  misc_feature 1..16: note = Synthetic oligonucleotide
  source 1..16: mol_type = other DNA
ccgttccaggcctcat

SEQ ID NO: 1692 - DNA, 16 bp, synthetic construct
  misc_feature 1..16: note = Synthetic oligonucleotide
  source 1..16: mol_type = other DNA
tccgttccaggcctca

SEQ ID NO: 1693 - DNA, 16 bp, synthetic construct
  misc_feature 1..16: note = Synthetic oligonucleotide
  source 1..16: mol_type = other DNA
aatccgttccaggcct

SEQ ID NO: 1694 - DNA, 16 bp, synthetic construct
  misc_feature 1..16: note = Synthetic oligonucleotide
  source 1..16: mol_type = other DNA
gaatccgttccaggcc

SEQ ID NO: 1695 - DNA, 16 bp, synthetic construct
  misc_feature 1..16: note = Synthetic oligonucleotide
  source 1..16: mol_type = other DNA
cgaatccgttccaggc

SEQ ID NO: 1696 - DNA, 16 bp, synthetic construct
  misc_feature 1..16: note = Synthetic oligonucleotide
  source 1..16: mol_type = other DNA
acgaatccgttccagg

SEQ ID NO: 1697 - DNA, 16 bp, synthetic construct
  misc_feature 1..16: note = Synthetic oligonucleotide
  source 1..16: mol_type = other DNA
cacgaatccgttccag

SEQ ID NO: 1698 - DNA, 16 bp, synthetic construct
  misc_feature 1..16: note = Synthetic oligonucleotide
  source 1..16: mol_type = other DNA
gccacgaatccgttcc

SEQ ID NO: 1699 - DNA, 16 bp, synthetic construct
  misc_feature 1..16: note = Synthetic oligonucleotide
  source 1..16: mol_type = other DNA
agccacgaatccgttc

SEQ ID NO: 1700 - DNA, 16 bp, synthetic construct
  misc_feature 1..16: note = Synthetic oligonucleotide
  source 1..16: mol_type = other DNA
cagccacgaatccgtt

SEQ ID NO: 1701 - DNA, 16 bp, synthetic construct
  misc_feature 1..16: note = Synthetic oligonucleotide
  source 1..16: mol_type = other DNA
gcagccacgaatccgt

SEQ ID NO: 1702 - DNA, 16 bp, synthetic construct
  misc_feature 1..16: note = Synthetic oligonucleotide
  source 1..16: mol_type = other DNA
agcagccacgaatccg

SEQ ID NO: 1703 - DNA, 16 bp, synthetic construct
  misc_feature 1..16: note = Synthetic oligonucleotide
  source 1..16: mol_type = other DNA
tcctgggcagttcagc

SEQ ID NO: 1704 - DNA, 16 bp, synthetic construct
  misc_feature 1..16: note = Synthetic oligonucleotide
  source 1..16: mol_type = other DNA
attcctgggcagttca

SEQ ID NO: 1705 - DNA, 16 bp, synthetic construct
  misc_feature 1..16: note = Synthetic oligonucleotide
  source 1..16: mol_type = other DNA
tcattcctgggcagtt

SEQ ID NO: 1706 - DNA, 16 bp, synthetic construct
  misc_feature 1..16: note = Synthetic oligonucleotide
  source 1..16: mol_type = other DNA
gtccagagctttacgg

SEQ ID NO: 1707 - DNA, 16 bp, synthetic construct
  misc_feature 1..16: note = Synthetic oligonucleotide
  source 1..16: mol_type = other DNA
gttgtccagagcttta

SEQ ID NO: 1708 - DNA, 16 bp, synthetic construct
  misc_feature 1..16: note = Synthetic oligonucleotide
  source 1..16: mol_type = other DNA
ggttgtccagagcttt

SEQ ID NO: 1709 - DNA, 16 bp, synthetic construct
  misc_feature 1..16: note = Synthetic oligonucleotide
  source 1..16: mol_type = other DNA
aggttgtccagagctt

SEQ ID NO: 1710 - DNA, 16 bp, synthetic construct
  misc_feature 1..16: note = Synthetic oligonucleotide
  source 1..16: mol_type = other DNA
aaggttgtccagagct

SEQ ID NO: 1711 - DNA, 16 bp, synthetic construct
  misc_feature 1..16: note = Synthetic oligonucleotide
  source 1..16: mol_type = other DNA
caaggttgtccagagc

SEQ ID NO: 1712 - DNA, 16 bp, synthetic construct
  misc_feature 1..16: note = Synthetic oligonucleotide
  source 1..16: mol_type = other DNA
gcaaggttgtccagag

SEQ ID NO: 1713 - DNA, 16 bp, synthetic construct
  misc_feature 1..16: note = Synthetic oligonucleotide
  source 1..16: mol_type = other DNA
tgtcttgcaaggttgt

SEQ ID NO: 1714 - DNA, 16 bp, synthetic construct
  misc_feature 1..16: note = Synthetic oligonucleotide
  source 1..16: mol_type = other DNA
ttgtcttgcaaggttg

SEQ ID NO: 1715 - DNA, 16 bp, synthetic construct
  misc_feature 1..16: note = Synthetic oligonucleotide
  source 1..16: mol_type = other DNA
tgttatcctcaagctc

SEQ ID NO: 1716 - DNA, 16 bp, synthetic construct
  misc_feature 1..16: note = Synthetic oligonucleotide
  source 1..16: mol_type = other DNA
gcctgcagaatcttat

SEQ ID NO: 1717 - DNA, 16 bp, synthetic construct
  misc_feature 1..16: note = Synthetic oligonucleotide
  source 1..16: mol_type = other DNA
cccctgccaggcatat

SEQ ID NO: 1718 - DNA, 16 bp, synthetic construct
  misc_feature 1..16: note = Synthetic oligonucleotide
  source 1..16: mol_type = other DNA
tgggtcaaaagcgatg

SEQ ID NO: 1719 - DNA, 16 bp, synthetic construct
  misc_feature 1..16: note = Synthetic oligonucleotide
  source 1..16: mol_type = other DNA
ttattgcaggctccaa

SEQ ID NO: 1720 - DNA, 16 bp, synthetic construct
  misc_feature 1..16: note = Synthetic oligonucleotide
  source 1..16: mol_type = other DNA
ttacttaccgggtaag

SEQ ID NO: 1721 - DNA, 16 bp, synthetic construct
  misc_feature 1..16: note = Synthetic oligonucleotide
  source 1..16: mol_type = other DNA
cagcaaacacgctccc

SEQ ID NO: 1722 - DNA, 16 bp, synthetic construct
  misc_feature 1..16: note = Synthetic oligonucleotide
  source 1..16: mol_type = other DNA
ggccgtgtcaccctaa

SEQ ID NO: 1723 - DNA, 16 bp, synthetic construct
  misc_feature 1..16: note = Synthetic oligonucleotide
  source 1..16: mol_type = other DNA
ggccaggtagccgtgt

SEQ ID NO: 1724 - DNA, 16 bp, synthetic construct
  misc_feature 1..16: note = Synthetic oligonucleotide
  source 1..16: mol_type = other DNA
gctgggtctgacccac

SEQ ID NO: 1725 - DNA, 16 bp, synthetic construct
  misc_feature 1..16: note = Synthetic oligonucleotide
  source 1..16: mol_type = other DNA
aaggagttgctgaaac

SEQ ID NO: 1726 - DNA, 16 bp, synthetic construct
  misc_feature 1..16: note = Synthetic oligonucleotide
  source 1..16: mol_type = other DNA
gcaggttcacatgaca

SEQ ID NO: 1727 - DNA, 16 bp, synthetic construct
  misc_feature 1..16: note = Synthetic oligonucleotide
  source 1..16: mol_type = other DNA
tctgttagatacaaac

SEQ ID NO: 1728 - DNA, 16 bp, synthetic construct
  misc_feature 1..16: note = Synthetic oligonucleotide
  source 1..16: mol_type = other DNA
tgggaaactcaactgg

SEQ ID NO: 1729 - DNA, 16 bp, synthetic construct
  misc_feature 1..16: note = Synthetic oligonucleotide
  source 1..16: mol_type = other DNA
tggatggaaggaacct

SEQ ID NO: 1730 - DNA, 16 bp, synthetic construct
  misc_feature 1..16: note = Synthetic oligonucleotide
  source 1..16: mol_type = other DNA
cattcagaatttccac

SEQ ID NO: 1731 - DNA, 16 bp, synthetic construct
  misc_feature 1..16: note = Synthetic oligonucleotide
  source 1..16: mol_type = other DNA
cccaccattgatgggt

SEQ ID NO: 1732 - DNA, 16 bp, synthetic construct
  misc_feature 1..16: note = Synthetic oligonucleotide
  source 1..16: mol_type = other DNA
tcactatcgatcaaat

SEQ ID NO: 1733 - DNA, 16 bp, synthetic construct
  misc_feature 1..16: note = Synthetic oligonucleotide
  source 1..16: mol_type = other DNA
cactttacatgcacga

SEQ ID NO: 1734 - DNA, 16 bp, synthetic construct
  misc_feature 1..16: note = Synthetic oligonucleotide
  source 1..16: mol_type = other DNA
tcatcatagatactcc

SEQ ID NO: 1735 - DNA, 16 bp, synthetic construct
  misc_feature 1..16: note = Synthetic oligonucleotide
  source 1..16: mol_type = other DNA
ggaggtgtgcctgtca

SEQ ID NO: 1736 - DNA, 16 bp, synthetic construct
  misc_feature 1..16: note = Synthetic oligonucleotide
  source 1..16: mol_type = other DNA
gctactcactgccagc

SEQ ID NO: 1737 - DNA, 16 bp, synthetic construct
  misc_feature 1..16: note = Synthetic oligonucleotide
  source 1..16: mol_type = other DNA
agaaatgaccctgttc

SEQ ID NO: 1738 - DNA, 16 bp, synthetic construct
  misc_feature 1..16: note = Synthetic oligonucleotide
  source 1..16: mol_type = other DNA
cacgatctcatttttc

SEQ ID NO: 1739 - DNA, 16 bp, synthetic construct
  misc_feature 1..16: note = Synthetic oligonucleotide
  source 1..16: mol_type = other DNA
atgcacgatctcattt

SEQ ID NO: 1740 - DNA, 16 bp, synthetic construct
  misc_feature 1..16: note = Synthetic oligonucleotide
  source 1..16: mol_type = other DNA
acatgcacgatctcat

SEQ ID NO: 1741 - DNA, 16 bp, synthetic construct
  misc_feature 1..16: note = Synthetic oligonucleotide
  source 1..16: mol_type = other DNA
tttacatgcacgatct

SEQ ID NO: 1742 - DNA, 16 bp, synthetic construct
  misc_feature 1..16: note = Synthetic oligonucleotide
  source 1..16: mol_type = other DNA
actttacatgcacgat

SEQ ID NO: 1743 - DNA, 16 bp, synthetic construct
  misc_feature 1..16: note = Synthetic oligonucleotide
  source 1..16: mol_type = other DNA
gtgtcagtcattatgc

SEQ ID NO: 1744 - DNA, 16 bp, synthetic construct
  misc_feature 1..16: note = Synthetic oligonucleotide
  source 1..16: mol_type = other DNA
gttaactgtgcaccta

SEQ ID NO: 1745 - DNA, 16 bp, synthetic construct
  misc_feature 1..16: note = Synthetic oligonucleotide
  source 1..16: mol_type = other DNA
agcttgtaagatgtta

SEQ ID NO: 1746 - DNA, 16 bp, synthetic construct
  misc_feature 1..16: note = Synthetic oligonucleotide
  source 1..16: mol_type = other DNA
gaagatccttaaccct

SEQ ID NO: 1747 - DNA, 16 bp, synthetic construct
  misc_feature 1..16: note = Synthetic oligonucleotide
  source 1..16: mol_type = other DNA
acattggttaggtcag

SEQ ID NO: 1748 - DNA, 16 bp, synthetic construct
  misc_feature 1..16: note = Synthetic oligonucleotide
  source 1..16: mol_type = other DNA
acacattggttaggtc

SEQ ID NO: 1749 - DNA, 16 bp, synthetic construct
  misc_feature 1..16: note = Synthetic oligonucleotide
  source 1..16: mol_type = other DNA
ggaattcctcagatga

SEQ ID NO: 1750 - DNA, 16 bp, synthetic construct
  misc_feature 1..16: note = Synthetic oligonucleotide
  source 1..16: mol_type = other DNA
gtttatggaattcctc

SEQ ID NO: 1751 - DNA, 16 bp, synthetic construct
  misc_feature 1..16: note = Synthetic oligonucleotide
  source 1..16: mol_type = other DNA
ggtcctgccgtgttta

SEQ ID NO: 1752 - DNA, 16 bp, synthetic construct
  misc_feature 1..16: note = Synthetic oligonucleotide
  source 1..16: mol_type = other DNA
tcctatcacattgagt

SEQ ID NO: 1753 - DNA, 16 bp, synthetic construct
  misc_feature 1..16: note = Synthetic oligonucleotide
  source 1..16: mol_type = other DNA
tgcctctaaggccttc

SEQ ID NO: 1754 - DNA, 16 bp, synthetic construct
  misc_feature 1..16: note = Synthetic oligonucleotide
  source 1..16: mol_type = other DNA
atcttggtgttggttc

SEQ ID NO: 1755 - DNA, 16 bp, synthetic construct
  misc_feature 1..16: note = Synthetic oligonucleotide
  source 1..16: mol_type = other DNA
ttaagtttcaagccct

SEQ ID NO: 1756 - DNA, 16 bp, synthetic construct
  misc_feature 1..16: note = Synthetic oligonucleotide
  source 1..16: mol_type = other DNA
gttcatgacctcctta

SEQ ID NO: 1757 - DNA, 16 bp, synthetic construct
  misc_feature 1..16: note = Synthetic oligonucleotide
  source 1..16: mol_type = other DNA
gtcctctgcaagttca

SEQ ID NO: 1758 - DNA, 16 bp, synthetic construct
  misc_feature 1..16: note = Synthetic oligonucleotide
  source 1..16: mol_type = other DNA
gatcatccagacaggg

SEQ ID NO: 1759 - DNA, 16 bp, synthetic construct
  misc_feature 1..16: note = Synthetic oligonucleotide
  source 1..16: mol_type = other DNA
gaacttgccagttcca

SEQ ID NO: 1760 - DNA, 16 bp, synthetic construct
  misc_feature 1..16: note = Synthetic oligonucleotide
  source 1..16: mol_type = other DNA
tgcttgtcaatgtcag

SEQ ID NO: 1761 - DNA, 16 bp, synthetic construct
  misc_feature 1..16: note = Synthetic oligonucleotide
  source 1..16: mol_type = other DNA
agacatactgcttgtc

SEQ ID NO: 1762 - DNA, 16 bp, synthetic construct
  misc_feature 1..16: note = Synthetic oligonucleotide
  source 1..16: mol_type = other DNA
tactatgaaaatggtc

SEQ ID NO: 1763 - DNA, 16 bp, synthetic construct
  misc_feature 1..16: note = Synthetic oligonucleotide
  source 1..16: mol_type = other DNA
agcaactaattctact

SEQ ID NO: 1764 - DNA, 16 bp, synthetic construct
  misc_feature 1..16: note = Synthetic oligonucleotide
  source 1..16: mol_type = other DNA
acaaattggcagcaac

SEQ ID NO: 1765 - DNA, 16 bp, synthetic construct
  misc_feature 1..16: note = Synthetic oligonucleotide
  source 1..16: mol_type = other DNA
acacaaattggcagca

SEQ ID NO: 1766 - DNA, 16 bp, synthetic construct
  misc_feature 1..16: note = Synthetic oligonucleotide
  source 1..16: mol_type = other DNA
cacctatataaattgc

SEQ ID NO: 1767 - DNA, 16 bp, synthetic construct
  misc_feature 1..16: note = Synthetic oligonucleotide
  source 1..16: mol_type = other DNA
gcaattttatggaacc

SEQ ID NO: 1768 - DNA, 16 bp, synthetic construct
  misc_feature 1..16: note = Synthetic oligonucleotide
  source 1..16: mol_type = other DNA
cttagtagtgacagct

SEQ ID NO: 1769 - DNA, 16 bp, synthetic construct
  misc_feature 1..16: note = Synthetic oligonucleotide
  source 1..16: mol_type = other DNA
agcctaactgatgcct

SEQ ID NO: 1770 - DNA, 16 bp, synthetic construct
  misc_feature 1..16: note = Synthetic oligonucleotide
  source 1..16: mol_type = other DNA
ggtctcactcgcaggt

SEQ ID NO: 1771 - DNA, 16 bp, synthetic construct
  misc_feature 1..16: note = Synthetic oligonucleotide
  source 1..16: mol_type = other DNA
ggctattcattctggc

SEQ ID NO: 1772 - DNA, 16 bp, synthetic construct
  misc_feature 1..16: note = Synthetic oligonucleotide
  source 1..16: mol_type = other DNA
ggagatctggctattc

SEQ ID NO: 1773 - DNA, 16 bp, synthetic construct
  misc_feature 1..16: note = Synthetic oligonucleotide
  source 1..16: mol_type = other DNA
gctactggttctggcc

SEQ ID NO: 1774 - DNA, 16 bp, synthetic construct
  misc_feature 1..16: note = Synthetic oligonucleotide
  source 1..16: mol_type = other DNA
gagtactttgaattca

SEQ ID NO: 1775 - DNA, 16 bp, synthetic construct
  misc_feature 1..16: note = Synthetic oligonucleotide
  source 1..16: mol_type = other DNA
gtctggctatctctga

SEQ ID NO: 1776 - DNA, 16 bp, synthetic construct
  misc_feature 1..16: note = Synthetic oligonucleotide
  source 1..16: mol_type = other DNA
agacattgcagtctgg

SEQ ID NO: 1777 - DNA, 16 bp, synthetic construct
  misc_feature 1..16: note = Synthetic oligonucleotide
  source 1..16: mol_type = other DNA
taaatttgcaggtggt

SEQ ID NO: 1778 - DNA, 16 bp, synthetic construct
  misc_feature 1..16: note = Synthetic oligonucleotide
  source 1..16: mol_type = other DNA
cttaaatttgcaggtg

SEQ ID NO: 1779 - DNA, 16 bp, synthetic construct
  misc_feature 1..16: note = Synthetic oligonucleotide
  source 1..16: mol_type = other DNA
ggatttagaaatcccc

SEQ ID NO: 1780 - DNA, 16 bp, synthetic construct
  misc_feature 1..16: note = Synthetic oligonucleotide
  source 1..16: mol_type = other DNA
tgtgttctttccgtgt

SEQ ID NO: 1781 - DNA, 16 bp, synthetic construct
  misc_feature 1..16: note = Synthetic oligonucleotide
  source 1..16: mol_type = other DNA
gacaatgaagcttcac

SEQ ID NO: 1782 - DNA, 16 bp, synthetic construct
  misc_feature 1..16: note = Synthetic oligonucleotide
  source 1..16: mol_type = other DNA
ttaactgggtgagctt

SEQ ID NO: 1783 - DNA, 16 bp, synthetic construct
  misc_feature 1..16: note = Synthetic oligonucleotide
  source 1..16: mol_type = other DNA
taatgtgattcacagg

SEQ ID NO: 1784 - DNA, 16 bp, synthetic construct
  misc_feature 1..16: note = Synthetic oligonucleotide
  source 1..16: mol_type = other DNA
ggtttaatgtgattca

SEQ ID NO: 1785 - DNA, 16 bp, synthetic construct
  misc_feature 1..16: note = Synthetic oligonucleotide
  source 1..16: mol_type = other DNA
cctgaaaaaaggcttc

SEQ ID NO: 1786 - DNA, 16 bp, synthetic construct
  misc_feature 1..16: note = Synthetic oligonucleotide
  source 1..16: mol_type = other DNA
tgtaacaacaatcctg

SEQ ID NO: 1787 - DNA, 16 bp, synthetic construct
  misc_feature 1..16: note = Synthetic oligonucleotide
  source 1..16: mol_type = other DNA
ttactatatttggagc

SEQ ID NO: 1788 - DNA, 16 bp, synthetic construct
  misc_feature 1..16: note = Synthetic oligonucleotide
  source 1..16: mol_type = other DNA
tgtctcctatcagtcc

SEQ ID NO: 1789 - DNA, 16 bp, synthetic construct
  misc_feature 1..16: note = Synthetic oligonucleotide
  source 1..16: mol_type = other DNA
caatttagcaggaacc

SEQ ID NO: 1790 - DNA, 16 bp, synthetic construct
  misc_feature 1..16: note = Synthetic oligonucleotide
  source 1..16: mol_type = other DNA
gattatgctcttcacc

SEQ ID NO: 1791 - DNA, 16 bp, synthetic construct
  misc_feature 1..16: note = Synthetic oligonucleotide
  source 1..16: mol_type = other DNA
tatctgattatgctct

SEQ ID NO: 1792 - DNA, 16 bp, synthetic construct
  misc_feature 1..16: note = Synthetic oligonucleotide
  source 1..16: mol_type = other DNA
tgattacgctttgcta

SEQ ID NO: 1793 - DNA, 16 bp, synthetic construct
  misc_feature 1..16: note = Synthetic oligonucleotide
  source 1..16: mol_type = other DNA
tctgattacgctttgc

SEQ ID NO: 1794 - DNA, 16 bp, synthetic construct
  misc_feature 1..16: note = Synthetic oligonucleotide
  source 1..16: mol_type = other DNA
agatactctggacact

SEQ ID NO: 1795 - DNA, 16 bp, synthetic construct
  misc_feature 1..16: note = Synthetic oligonucleotide
  source 1..16: mol_type = other DNA
ggcagcttgtgatcca

SEQ ID NO: 1796 - DNA, 16 bp, synthetic construct
  misc_feature 1..16: note = Synthetic oligonucleotide
  source 1..16: mol_type = other DNA
ccgtataggaatctga

SEQ ID NO: 1797 - DNA, 16 bp, synthetic construct
  misc_feature 1..16: note = Synthetic oligonucleotide
  source 1..16: mol_type = other DNA
ggtgatttggccacgg

SEQ ID NO: 1798 - DNA, 16 bp, synthetic construct
  misc_feature 1..16: note = Synthetic oligonucleotide
  source 1..16: mol_type = other DNA
agtgatctccaggccc

SEQ ID NO: 1799 - DNA, 16 bp, synthetic construct
  misc_feature 1..16: note = Synthetic oligonucleotide
  source 1..16: mol_type = other DNA
gtgactgccaaagtgt

SEQ ID NO: 1800 - DNA, 16 bp, synthetic construct
  misc_feature 1..16: note = Synthetic oligonucleotide
  source 1..16: mol_type = other DNA
ttgataaagatgcctc

SEQ ID NO: 1801 - DNA, 16 bp, synthetic construct
  misc_feature 1..16: note = Synthetic oligonucleotide
  source 1..16: mol_type = other DNA
tttcatggtaggtgtt

SEQ ID NO: 1802 - DNA, 16 bp, synthetic construct
  misc_feature 1..16: note = Synthetic oligonucleotide
  source 1..16: mol_type = other DNA
atactcctcaatattt

SEQ ID NO: 1803 - DNA, 16 bp, synthetic construct
  misc_feature 1..16: note = Synthetic oligonucleotide
  source 1..16: mol_type = other DNA
tagatactcctcaata

SEQ ID NO: 1804 - DNA, 16 bp, synthetic construct
  misc_feature 1..16: note = Synthetic oligonucleotide
  source 1..16: mol_type = other DNA
catcatagatactcct

SEQ ID NO: 1805 - DNA, 16 bp, synthetic construct
  misc_feature 1..16: note = Synthetic oligonucleotide
  source 1..16: mol_type = other DNA
gttcatcatagatact

SEQ ID NO: 1806 - DNA, 16 bp, synthetic construct
  misc_feature 1..16: note = Synthetic oligonucleotide
  source 1..16: mol_type = other DNA
gatctctatcctgtgt

SEQ ID NO: 1807 - DNA, 16 bp, synthetic construct
  misc_feature 1..16: note = Synthetic oligonucleotide
  source 1..16: mol_type = other DNA
gactcgaacaagtcca

SEQ ID NO: 1808 - DNA, 16 bp, synthetic construct
  misc_feature 1..16: note = Synthetic oligonucleotide
  source 1..16: mol_type = other DNA
cttcatcggtccatcg

SEQ ID NO: 1809 - DNA, 16 bp, synthetic construct
  misc_feature 1..16: note = Synthetic oligonucleotide
  source 1..16: mol_type = other DNA
tccaggtacccttcta

SEQ ID NO: 1810 - DNA, 16 bp, synthetic construct
  misc_feature 1..16: note = Synthetic oligonucleotide
  source 1..16: mol_type = other DNA
agacatcaccttgtcc

SEQ ID NO: 1811 - DNA, 16 bp, synthetic construct
  misc_feature 1..16: note = Synthetic oligonucleotide
  source 1..16: mol_type = other DNA
attcttcctggagtgc

SEQ ID NO: 1812 - DNA, 16 bp, synthetic construct
  misc_feature 1..16: note = Synthetic oligonucleotide
  source 1..16: mol_type = other DNA
tgaggctactcactgc

SEQ ID NO: 1813 - DNA, 16 bp, synthetic construct
  misc_feature 1..16: note = Synthetic oligonucleotide
  source 1..16: mol_type = other DNA
gtaactggcaaagttc

SEQ ID NO: 1814 - DNA, 16 bp, synthetic construct
  misc_feature 1..16: note = Synthetic oligonucleotide
  source 1..16: mol_type = other DNA
tgcacgatctcatttt

SEQ ID NO: 1815 - DNA, 16 bp, synthetic construct
  misc_feature 1..16: note = Synthetic oligonucleotide
  source 1..16: mol_type = other DNA
catgcacgatctcatt

SEQ ID NO: 1816 - DNA, 16 bp, synthetic construct
  misc_feature 1..16: note = Synthetic oligonucleotide
  source 1..16: mol_type = other DNA
tacatgcacgatctca

SEQ ID NO: 1817 - DNA, 16 bp, synthetic construct
  misc_feature 1..16: note = Synthetic oligonucleotide
  source 1..16: mol_type = other DNA
ctttacatgcacgatc

SEQ ID NO: 1818 - DNA, 16 bp, synthetic construct
  misc_feature 1..16: note = Synthetic oligonucleotide
  source 1..16: mol_type = other DNA
gcactttacatgcacg

SEQ ID NO: 1819 - DNA, 16 bp, synthetic construct
  misc_feature 1..16: note = Synthetic oligonucleotide
  source 1..16: mol_type = other DNA
gtgtgtcagtcattat

SEQ ID NO: 1820 - DNA, 16 bp, synthetic construct
  misc_feature 1..16: note = Synthetic oligonucleotide
  source 1..16: mol_type = other DNA
cgttaactgtgcacct

SEQ ID NO: 1821 - DNA, 16 bp, synthetic construct
  misc_feature 1..16: note = Synthetic oligonucleotide
  source 1..16: mol_type = other DNA
tccttaaccctggttc

SEQ ID NO: 1822 - DNA, 16 bp, synthetic construct
  misc_feature 1..16: note = Synthetic oligonucleotide
  source 1..16: mol_type = other DNA
tcaagaagaagatcct

SEQ ID NO: 1823 - DNA, 16 bp, synthetic construct
  misc_feature 1..16: note = Synthetic oligonucleotide
  source 1..16: mol_type = other DNA
cacattggttaggtca

SEQ ID NO: 1824 - DNA, 16 bp, synthetic construct
  misc_feature 1..16: note = Synthetic oligonucleotide
  source 1..16: mol_type = other DNA
acacacattggttagg

SEQ ID NO: 1825 - DNA, 16 bp, synthetic construct
  misc_feature 1..16: note = Synthetic oligonucleotide
  source 1..16: mol_type = other DNA
tatggaattcctcaga

SEQ ID NO: 1826 - DNA, 16 bp, synthetic construct
  misc_feature 1..16: note = Synthetic oligonucleotide
  source 1..16: mol_type = other DNA
cgtgtttatggaattc

SEQ ID NO: 1827 - DNA, 16 bp, synthetic construct
  misc_feature 1..16: note = Synthetic oligonucleotide
  source 1..16: mol_type = other DNA
tcacattgagttgcta

SEQ ID NO: 1828 - DNA, 16 bp, synthetic construct
  misc_feature 1..16: note = Synthetic oligonucleotide
  source 1..16: mol_type = other DNA
gcctctaaggccttca

SEQ ID NO: 1829 - DNA, 16 bp, synthetic construct
  misc_feature 1..16: note = Synthetic oligonucleotide
  source 1..16: mol_type = other DNA
ggtgttggttccccac

SEQ ID NO: 1830 - DNA, 16 bp, synthetic construct
  misc_feature 1..16: note = Synthetic oligonucleotide
  source 1..16: mol_type = other DNA
gctgatcccggtctct

SEQ ID NO: 1831 - DNA, 16 bp, synthetic construct
  misc_feature 1..16: note = Synthetic oligonucleotide
  source 1..16: mol_type = other DNA
tccttaagtttcaagc

SEQ ID NO: 1832 - DNA, 16 bp, synthetic construct
  misc_feature 1..16: note = Synthetic oligonucleotide
  source 1..16: mol_type = other DNA
tgcaagttcatgacct

SEQ ID NO: 1833 - DNA, 16 bp, synthetic construct
  misc_feature 1..16: note = Synthetic oligonucleotide
  source 1..16: mol_type = other DNA
gaaatatccctctccc

SEQ ID NO: 1834 - DNA, 16 bp, synthetic construct
  misc_feature 1..16: note = Synthetic oligonucleotide
  source 1..16: mol_type = other DNA
ccctatatgcccatga

SEQ ID NO: 1835 - DNA, 16 bp, synthetic construct
  misc_feature 1..16: note = Synthetic oligonucleotide
  source 1..16: mol_type = other DNA
agaacttgccagttcc

SEQ ID NO: 1836 - DNA, 16 bp, synthetic construct
  misc_feature 1..16: note = Synthetic oligonucleotide
  source 1..16: mol_type = other DNA
gacatactgcttgtca

SEQ ID NO: 1837 - DNA, 16 bp, synthetic construct
  misc_feature 1..16: note = Synthetic oligonucleotide
  source 1..16: mol_type = other DNA
gtcactaagacatact

SEQ ID NO: 1838 - DNA, 16 bp, synthetic construct
  misc_feature 1..16: note = Synthetic oligonucleotide
  source 1..16: mol_type = other DNA
gcaactaattctacta

SEQ ID NO: 1839 - DNA, 16 bp, synthetic construct
  misc_feature 1..16: note = Synthetic oligonucleotide
  source 1..16: mol_type = other DNA
caaattggcagcaact

SEQ ID NO: 1840 - DNA, 16 bp, synthetic construct
  misc_feature 1..16: note = Synthetic oligonucleotide
  source 1..16: mol_type = other DNA
cacaaattggcagcaa

SEQ ID NO: 1841 - DNA, 16 bp, synthetic construct
  misc_feature 1..16: note = Synthetic oligonucleotide
  source 1..16: mol_type = other DNA
acctatataaattgct

SEQ ID NO: 1842 - DNA, 16 bp, synthetic construct
  misc_feature 1..16: note = Synthetic oligonucleotide
  source 1..16: mol_type = other DNA
attttatggaacctct

SEQ ID NO: 1843 - DNA, 16 bp, synthetic construct
  misc_feature 1..16: note = Synthetic oligonucleotide
  source 1..16: mol_type = other DNA
agcttcacctgtgtgc

SEQ ID NO: 1844 - DNA, 16 bp, synthetic construct
  misc_feature 1..16: note = Synthetic oligonucleotide
  source 1..16: mol_type = other DNA
tgccttagtagtgaca

SEQ ID NO: 1845 - DNA, 16 bp, synthetic construct
  misc_feature 1..16: note = Synthetic oligonucleotide
  source 1..16: mol_type = other DNA
tcactcgcaggtgtca

SEQ ID NO: 1846 - DNA, 16 bp, synthetic construct
  misc_feature 1..16: note = Synthetic oligonucleotide
  source 1..16: mol_type = other DNA
gctattcattctggct

SEQ ID NO: 1847 - DNA, 16 bp, synthetic construct
  misc_feature 1..16: note = Synthetic oligonucleotide
  source 1..16: mol_type = other DNA
tggctattcattctgg

SEQ ID NO: 1848 - DNA, 16 bp, synthetic construct
  misc_feature 1..16: note = Synthetic oligonucleotide
  source 1..16: mol_type = other DNA
tggttctggccactgc

SEQ ID NO: 1849 - DNA, 16 bp, synthetic construct
  misc_feature 1..16: note = Synthetic oligonucleotide
  source 1..16: mol_type = other DNA
ggagttcactttgcct

SEQ ID NO: 1850 - DNA, 16 bp, synthetic construct
  misc_feature 1..16: note = Synthetic oligonucleotide
  source 1..16: mol_type = other DNA
gctatctctgagtact

SEQ ID NO: 1851 - DNA, 16 bp, synthetic construct
  misc_feature 1..16: note = Synthetic oligonucleotide
  source 1..16: mol_type = other DNA
gacattgcagtctggc

SEQ ID NO: 1852 - DNA, 16 bp, synthetic construct
  misc_feature 1..16: note = Synthetic oligonucleotide
  source 1..16: mol_type = other DNA
tcagacattgcagtct

SEQ ID NO: 1853 - DNA, 16 bp, synthetic construct
  misc_feature 1..16: note = Synthetic oligonucleotide
  source 1..16: mol_type = other DNA
ttaaatttgcaggtgg

SEQ ID NO: 1854 - DNA, 16 bp, synthetic construct
  misc_feature 1..16: note = Synthetic oligonucleotide
  source 1..16: mol_type = other DNA
cccttaaatttgcagg

SEQ ID NO: 1855 - DNA, 16 bp, synthetic construct
  misc_feature 1..16: note = Synthetic oligonucleotide
  source 1..16: mol_type = other DNA
tggatttagaaatccc

SEQ ID NO: 1856 - DNA, 16 bp, synthetic construct
  misc_feature 1..16: note = Synthetic oligonucleotide
  source 1..16: mol_type = other DNA
tgaagcttcacactta

SEQ ID NO: 1857 - DNA, 16 bp, synthetic construct
  misc_feature 1..16: note = Synthetic oligonucleotide
  source 1..16: mol_type = other DNA
aggacaatgaagcttc

SEQ ID NO: 1858 - DNA, 16 bp, synthetic construct
  misc_feature 1..16: note = Synthetic oligonucleotide
  source 1..16: mol_type = other DNA
tccttaactgggtgag

SEQ ID NO: 1859 - DNA, 16 bp, synthetic construct
  misc_feature 1..16: note = Synthetic oligonucleotide
  source 1..16: mol_type = other DNA
gtttaatgtgattcac

SEQ ID NO: 1860 - DNA, 16 bp, synthetic construct
  misc_feature 1..16: note = Synthetic oligonucleotide
  source 1..16: mol_type = other DNA
tggtttaatgtgattc

SEQ ID NO: 1861 - DNA, 16 bp, synthetic construct
  misc_feature 1..16: note = Synthetic oligonucleotide
  source 1..16: mol_type = other DNA
gtaacaacaatcctga

SEQ ID NO: 1862 - DNA, 16 bp, synthetic construct
  misc_feature 1..16: note = Synthetic oligonucleotide
  source 1..16: mol_type = other DNA
tactatatttggagct

SEQ ID NO: 1863 - DNA, 16 bp, synthetic construct
  misc_feature 1..16: note = Synthetic oligonucleotide
  source 1..16: mol_type = other DNA
gtctttactatatttg

SEQ ID NO: 1864 - DNA, 16 bp, synthetic construct
  misc_feature 1..16: note = Synthetic oligonucleotide
  source 1..16: mol_type = other DNA
aatttagcaggaaccc

SEQ ID NO: 1865 - DNA, 16 bp, synthetic construct
  misc_feature 1..16: note = Synthetic oligonucleotide
  source 1..16: mol_type = other DNA
gagaatcctgttaggc

SEQ ID NO: 1866 - DNA, 16 bp, synthetic construct
  misc_feature 1..16: note = Synthetic oligonucleotide
  source 1..16: mol_type = other DNA
tgattatgctcttcac

SEQ ID NO: 1867 - DNA, 16 bp, synthetic construct
  misc_feature 1..16: note = Synthetic oligonucleotide
  source 1..16: mol_type = other DNA
gctatctgattatgct

SEQ ID NO: 1868 - DNA, 16 bp, synthetic construct
  misc_feature 1..16: note = Synthetic oligonucleotide
  source 1..16: mol_type = other DNA
ctgattacgctttgct

SEQ ID NO: 1869 - DNA, 16 bp, synthetic construct
  misc_feature 1..16: note = Synthetic oligonucleotide
  source 1..16: mol_type = other DNA
gacactaaggcatggg

SEQ ID NO: 1870 - DNA, 16 bp, synthetic construct
  misc_feature 1..16: note = Synthetic oligonucleotide
  source 1..16: mol_type = other DNA
gcagatactctggaca

SEQ ID NO: 1871 - DNA, 16 bp, synthetic construct
  misc_feature 1..16: note = Synthetic oligonucleotide
  source 1..16: mol_type = other DNA
gggctatttggtgtct

SEQ ID NO: 1872 - DNA, 16 bp, synthetic construct
  misc_feature 1..16: note = Synthetic oligonucleotide
  source 1..16: mol_type = other DNA
tgatttggccacggga

SEQ ID NO: 1873 - DNA, 16 bp, synthetic construct
  misc_feature 1..16: note = Synthetic oligonucleotide
  source 1..16: mol_type = other DNA
gaacatctgtctttgc

SEQ ID NO: 1874 - DNA, 16 bp, synthetic construct
  misc_feature 1..16: note = Synthetic oligonucleotide
  source 1..16: mol_type = other DNA
agcatgaactttaccc

SEQ ID NO: 1875 - DNA, 16 bp, synthetic construct
  misc_feature 1..16: note = Synthetic oligonucleotide
  source 1..16: mol_type = other DNA
caggtcaacaccgtga

SEQ ID NO: 1876 - DNA, 16 bp, synthetic construct
  misc_feature 1..16: note = Synthetic oligonucleotide
  source 1..16: mol_type = other DNA
gtttgataaagatgcc

SEQ ID NO: 1877 - DNA, 16 bp, synthetic construct
  misc_feature 1..16: note = Synthetic oligonucleotide
  source 1..16: mol_type = other DNA
tactcctcaatattta

SEQ ID NO: 1878 - DNA, 16 bp, synthetic construct
  misc_feature 1..16: note = Synthetic oligonucleotide
  source 1..16: mol_type = other DNA
gatactcctcaatatt

SEQ ID NO: 1879 - DNA, 16 bp, synthetic construct
  misc_feature 1..16: note = Synthetic oligonucleotide
  source 1..16: mol_type = other DNA
atcatagatactcctc

SEQ ID NO: 1880 - DNA, 16 bp, synthetic construct
  misc_feature 1..16: note = Synthetic oligonucleotide
  source 1..16: mol_type = other DNA
ttcatcatagatactc

SEQ ID NO: 1881 - DNA, 16 bp, synthetic construct
  misc_feature 1..16: note = Synthetic oligonucleotide
  source 1..16: mol_type = other DNA
gtgtaaattgcagagc

SEQ ID NO: 1882 - DNA, 16 bp, synthetic construct
  misc_feature 1..16: note = Synthetic oligonucleotide
  source 1..16: mol_type = other DNA
tgtgaaatgagctcca

SEQ ID NO: 1883 - DNA, 16 bp, synthetic construct
  misc_feature 1..16: note = Synthetic oligonucleotide
  source 1..16: mol_type = other DNA
atgactcgaacaagtc

SEQ ID NO: 1884 - DNA, 16 bp, synthetic construct
  misc_feature 1..16: note = Synthetic oligonucleotide
  source 1..16: mol_type = other DNA
tggaacttcatcggtc

SEQ ID NO: 1885 - DNA, 16 bp, synthetic construct
  misc_feature 1..16: note = Synthetic oligonucleotide
  source 1..16: mol_type = other DNA
gacatcaccttgtcca

SEQ ID NO: 1886 - DNA, 16 bp, synthetic construct
  misc_feature 1..16: note = Synthetic oligonucleotide
  source 1..16: mol_type = other DNA
ggaagtcaggcaccca

SEQ ID NO: 1887 - DNA, 16 bp, synthetic construct
  misc_feature 1..16: note = Synthetic oligonucleotide
  source 1..16: mol_type = other DNA
tgttatatttgatcct

SEQ ID NO: 1888 - DNA, 16 bp, synthetic construct
  misc_feature 1..16: note = Synthetic oligonucleotide
  source 1..16: mol_type = other DNA
gaacgcaatgctgact

SEQ ID NO: 1889 - DNA, 16 bp, synthetic construct
  misc_feature 1..16: note = Synthetic oligonucleotide
  source 1..16: mol_type = other DNA
cagcattgagtacaac

SEQ ID NO: 1890 - DNA, 16 bp, synthetic construct
  misc_feature 1..16: note = Synthetic oligonucleotide
  source 1..16: mol_type = other DNA
ctttataccagtgtct

SEQ ID NO: 1891 - DNA, 16 bp, synthetic construct
  misc_feature 1..16: note = Synthetic oligonucleotide
  source 1..16: mol_type = other DNA
gagaacattgaaacac

SEQ ID NO: 1892 - DNA, 16 bp, synthetic construct
  misc_feature 1..16: note = Synthetic oligonucleotide
  source 1..16: mol_type = other DNA
tagtgctatagaggga

SEQ ID NO: 1893 - DNA, 16 bp, synthetic construct
  misc_feature 1..16: note = Synthetic oligonucleotide
  source 1..16: mol_type = other DNA
ttacatgcacgatctc

SEQ ID NO: 1894 - DNA, 16 bp, synthetic construct
  misc_feature 1..16: note = Synthetic oligonucleotide
  source 1..16: mol_type = other DNA
aattttatggaacctc

SEQ ID NO: 1895 - DNA, 16 bp, synthetic construct
  misc_feature 1..16: note = Synthetic oligonucleotide
  source 1..16: mol_type = other DNA
tcatagatactcctca

SEQ ID NO: 1896 - DNA, 16 bp, synthetic construct
  misc_feature 1..16: note = Synthetic oligonucleotide
  source 1..16: mol_type = other DNA
ccctaacactcagttc

SEQ ID NO: 1897 - DNA, 16 bp, synthetic construct
  misc_feature 1..16: note = Synthetic oligonucleotide
  source 1..16: mol_type = other DNA
tccgtcaatatattct

SEQ ID NO: 1898 - DNA, 16 bp, synthetic construct
  misc_feature 1..16: note = Synthetic oligonucleotide
  source 1..16: mol_type = other DNA
ggtaagagcgatggga

SEQ ID NO: 1899 - DNA, 16 bp, synthetic construct
  misc_feature 1..16: note = Synthetic oligonucleotide
  source 1..16: mol_type = other DNA
gagtattgtttttgtg

SEQ ID NO: 1900 - DNA, 16 bp, synthetic construct
  misc_feature 1..16: note = Synthetic oligonucleotide
  source 1..16: mol_type = other DNA
gttatatttgatcctc

SEQ ID NO: 1901 - DNA, 16 bp, synthetic construct
  misc_feature 1..16: note = Synthetic oligonucleotide
  source 1..16: mol_type = other DNA
ctaattttctgactgt

SEQ ID NO: 1902 - DNA, 16 bp, synthetic construct
  misc_feature 1..16: note = Synthetic oligonucleotide
  source 1..16: mol_type = other DNA
attcagaatttccact

SEQ ID NO: 1903 - DNA, 16 bp, synthetic construct
  misc_feature 1..16: note = Synthetic oligonucleotide
  source 1..16: mol_type = other DNA
gcaatgctgacttggc

SEQ ID NO: 1904 - DNA, 16 bp, synthetic construct
  misc_feature 1..16: note = Synthetic oligonucleotide
  source 1..16: mol_type = other DNA
tatttcttgatgtggt

SEQ ID NO: 1905 - DNA, 16 bp, synthetic construct
  misc_feature 1..16: note = Synthetic oligonucleotide
  source 1..16: mol_type = other DNA
acgcaatgctgacttg

SEQ ID NO: 1906 - DNA, 16 bp, synthetic construct
  misc_feature 1..16: note = Synthetic oligonucleotide
  source 1..16: mol_type = other DNA
cgtgttatatttgatc

SEQ ID NO: 1907 - DNA, 16 bp, synthetic construct
  misc_feature 1..16: note = Synthetic oligonucleotide
  source 1..16: mol_type = other DNA
caacacatcattgggt

SEQ ID NO: 1908 - DNA, 16 bp, synthetic construct
  misc_feature 1..16: note = Synthetic oligonucleotide
  source 1..16: mol_type = other DNA
cactttataccagtgt

SEQ ID NO: 1909 - DNA, 16 bp, synthetic construct
  misc_feature 1..16: note = Synthetic oligonucleotide
  source 1..16: mol_type = other DNA
ttatatttgatcctca

SEQ ID NO: 1910 - DNA, 16 bp, synthetic construct
  misc_feature 1..16: note = Synthetic oligonucleotide
  source 1..16: mol_type = other DNA
ttatgaaattattggt

SEQ ID NO: 1911 - DNA, 16 bp, synthetic construct
  misc_feature 1..16: note = Synthetic oligonucleotide
  source 1..16: mol_type = other DNA
aagtattgccagctaa

SEQ ID NO: 1912 - DNA, 16 bp, synthetic construct
  misc_feature 1..16: note = Synthetic oligonucleotide
  source 1..16: mol_type = other DNA
atgctaattttctgac

SEQ ID NO: 1913 - DNA, 16 bp, synthetic construct
  misc_feature 1..16: note = Synthetic oligonucleotide
  source 1..16: mol_type = other DNA
ggcattcagaatttcc

SEQ ID NO: 1914 - DNA, 16 bp, synthetic construct
  misc_feature 1..16: note = Synthetic oligonucleotide
  source 1..16: mol_type = other DNA
tttataccagtgtctt

SEQ ID NO: 1915 - DNA, 16 bp, synthetic construct
  misc_feature 1..16: note = Synthetic oligonucleotide
  source 1..16: mol_type = other DNA
tattctcatggtacag

SEQ ID NO: 1916 - DNA, 16 bp, synthetic construct
  misc_feature 1..16: note = Synthetic oligonucleotide
  source 1..16: mol_type = other DNA
tgagtattgtttttgt

SEQ ID NO: 1917 - DNA, 16 bp, synthetic construct
  misc_feature 1..16: note = Synthetic oligonucleotide
  source 1..16: mol_type = other DNA
agttttgtaagtgcaa

SEQ ID NO: 1918 - DNA, 16 bp, synthetic construct
  misc_feature 1..16: note = Synthetic oligonucleotide
  source 1..16: mol_type = other DNA
taagtattgccagcta

SEQ ID NO: 1919 - DNA, 16 bp, synthetic construct
  misc_feature 1..16: note = Synthetic oligonucleotide
  source 1..16: mol_type = other DNA
aacgcaatgctgactt

SEQ ID NO: 1920 - DNA, 16 bp, synthetic construct
  misc_feature 1..16: note = Synthetic oligonucleotide
  source 1..16: mol_type = other DNA
agctttaaactcaggt

SEQ ID NO: 1921 - DNA, 16 bp, synthetic construct
  misc_feature 1..16: note = Synthetic oligonucleotide
  source 1..16: mol_type = other DNA
gtattgtttttgtggg

SEQ ID NO: 1922 - DNA, 16 bp, synthetic construct
  misc_feature 1..16: note = Synthetic oligonucleotide
  source 1..16: mol_type = other DNA
agtattgtttttgtgg

SEQ ID NO: 1923 - DNA, 16 bp, synthetic construct
  misc_feature 1..16: note = Synthetic oligonucleotide
  source 1..16: mol_type = other DNA
aattatggaattgcag

SEQ ID NO: 1924 - DNA, 16 bp, synthetic construct
  misc_feature 1..16: note = Synthetic oligonucleotide
  source 1..16: mol_type = other DNA
cgcaatgctgacttgg

SEQ ID NO: 1925 - DNA, 16 bp, synthetic construct
  misc_feature 1..16: note = Synthetic oligonucleotide
  source 1..16: mol_type = other DNA
cgtcaatatattcttt

SEQ ID NO: 1926 - DNA, 16 bp, synthetic construct
  misc_feature 1..16: note = Synthetic oligonucleotide
  source 1..16: mol_type = other DNA
tgtatttcttgatgtg

SEQ ID NO: 1927 - DNA, 16 bp, synthetic construct
  misc_feature 1..16: note = Synthetic oligonucleotide
  source 1..16: mol_type = other DNA
ttattctcatggtaca

SEQ ID NO: 1928 - DNA, 16 bp, synthetic construct
  misc_feature 1..16: note = Synthetic oligonucleotide
  source 1..16: mol_type = other DNA
gtgagtattgtttttg

SEQ ID NO: 1929 - DNA, 16 bp, synthetic construct
  misc_feature 1..16: note = Synthetic oligonucleotide
  source 1..16: mol_type = other DNA
tgggaattatggaatt

SEQ ID NO: 1930 - DNA, 16 bp, synthetic construct
  misc_feature 1..16: note = Synthetic oligonucleotide
  source 1..16: mol_type = other DNA
ggttatgaaattattg

SEQ ID NO: 1931 - DNA, 16 bp, synthetic construct
  misc_feature 1..16: note = Synthetic oligonucleotide
  source 1..16: mol_type = other DNA
tgaagattggctctgg

SEQ ID NO: 1932 - DNA, 16 bp, synthetic construct
  misc_feature 1..16: note = Synthetic oligonucleotide
  source 1..16: mol_type = other DNA
tatatttgatcctcaa

SEQ ID NO: 1933 - DNA, 16 bp, synthetic construct
  misc_feature 1..16: note = Synthetic oligonucleotide
  source 1..16: mol_type = other DNA
gtaagtattgccagct

SEQ ID NO: 1934 - DNA, 16 bp, synthetic construct
  misc_feature 1..16: note = Synthetic oligonucleotide
  source 1..16: mol_type = other DNA
gtgttatatttgatcc

SEQ ID NO: 1935 - DNA, 16 bp, synthetic construct
  misc_feature 1..16: note = Synthetic oligonucleotide
  source 1..16: mol_type = other DNA
gggttatgaaattatt

SEQ ID NO: 1936 - DNA, 16 bp, synthetic construct
  misc_feature 1..16: note = Synthetic oligonucleotide
  source 1..16: mol_type = other DNA
ccgtcaatatattctt

SEQ ID NO: 1937 - DNA, 16 bp, synthetic construct
  misc_feature 1..16: note = Synthetic oligonucleotide
  source 1..16: mol_type = other DNA
gcattcagaatttcca

SEQ ID NO: 1938 - DNA, 16 bp, synthetic construct
  misc_feature 1..16: note = Synthetic oligonucleotide
  source 1..16: mol_type = other DNA
ttataccagtgtcttc

SEQ ID NO: 1939 - DNA, 16 bp, synthetic construct
  misc_feature 1..16: note = Synthetic oligonucleotide
  source 1..16: mol_type = other DNA
ctgaagattggctctg

SEQ ID NO: 1940 - DNA, 16 bp, synthetic construct
  misc_feature 1..16: note = Synthetic oligonucleotide
  source 1..16: mol_type = other DNA
gtgtatttcttgatgt

SEQ ID NO: 1941 - DNA, 16 bp, synthetic construct
  misc_feature 1..16: note = Synthetic oligonucleotide
  source 1..16: mol_type = other DNA
actttataccagtgtc

SEQ ID NO: 1942 - DNA, 21 bp, synthetic construct
  misc_feature 1..21: note = Primer
  source 1..21: mol_type = other DNA
ggcagccttgtactcttggaa

SEQ ID NO: 1943 - DNA, 20 bp, synthetic construct
  misc_feature 1..20: note = Primer
  source 1..20: mol_type = other DNA
gctggtaatcccggtcaaag

SEQ ID NO: 1944 - DNA, 26 bp, synthetic construct
  misc_feature 1..26: note = Probe
  source 1..26: mol_type = other DNA
ctgggatggagttgggaatcacagcc

SEQ ID NO: 1945 - DNA, 22 bp, synthetic construct
  misc_feature 1..22: note = Primer
  source 1..22: mol_type = other DNA
ctcctgctgagtgaccataaag

SEQ ID NO: 1946 - DNA, 20 bp, synthetic construct
  misc_feature 1..20: note = Primer
  source 1..20: mol_type = other DNA
ggacttcttcgagccagttt

SEQ ID NO: 1947 - DNA, 24 bp, synthetic construct
  misc_feature 1..24: note = Probe
  source 1..24: mol_type = other DNA
agagtggtggctactgctgaactg

SEQ ID NO: 1948 - DNA, 16 bp, synthetic construct
  misc_feature 1..16: note = Synthetic oligonucleotide
  source 1..16: mol_type = other DNA
ggctactacgccgtca

SEQ ID NO: 1949 - DNA, 14654 bp, Macaca fascicularis
  source 1..14654: mol_type = other DNA
catgccagcagggaaggggagctggcatgtcaatggtaagcatgggaacaagaggagggaggcagagctctcacactcttttaaacaatcagatgttgcatgaattgagtcaaaactcactcagctccaaggggatgacgctcagccattcatgaggaatctgcccccatgatccaatacctcccactaggcccccttccaatgctgaaggtcacatttcctcatgaagtttgaaggggacacatattcaaatcatatcattcaacacaacccccccatcacatgttcttctcacattgcaaaacacagtcatcccttcccaggggtctcccaaagtcataatttgttccaacctcaagtccaaagttctaaatcacattcaaagacccctccttccagctaggggcctgtaaaatcaaaacaagttactccaggataaaatggtggcatagacattgcataaacactcccattccaaaagaaagaagtcggccaaaagaaagaggcaacatgcccccatgcaagtcccaaacccagcagggcagacgtgaaactttaactctccagaacaatctttgaatccatgtcccatacctagggcacgctggcacaagtgttggtcccccgaggctttgagcagctctgcccctgtggcttttcagggggcagctgctgtggctgctgctacagatggattacagttgagtgcatgtggcctttccaggctcaggatggaagctactcgtggctctaaaattacgggatctggagggtgactgccctcttcccacagcctcactaggtagtgccctggtggggactctgtgtaggcgctcctaccctacctttcccctcagcactgtcctagtagattatctctgtggggaatttgtcctgctgcaggcttctacctgggcacccaggcttttccacaaaccctctgaaatctagatagaagctaccaagtctccttcactcttgaattctgcacacctgaagacctaaaccatatacggaagctgccaaggtggcttgcaccctctggggcggtgtcccaagccacctttaaactgagggtgtaactggagcaaccagtaggtgaggagcagggtcctgaggctgagaaggggaccaacatcccaaagctgggcccttaaatcatttttcctctctgagttgttggatgaaagcaacttcctctcctcttgcttcggtttcctcatcagcaaaatcagatcataatcctggcccattgaggggatgattataaaactcaatcaaatggagaagtatttgcaaatggaatgtattgcaacgtgtattgtgcagtccctgtgtaatcacctttttgttcctgcctcacaagctgggttatgtgtgtaggggtggggggaggtggccacgatgcccccagagatgtttgctgaggatgaaataggcttccatgaaagggtcagtttggcttctgtggttcagctgtctttgaggcccttctgcctggggcaaagcacaaaagtccaacagcaatctggttgcctgacttcttagccatggaagtgtggtgagcagtggtctctagtccctccacccagtgtgcctcgggagtggaacatggggcggtggcctctgctggggaggatgctgggggttctctgaaaggaggcaatgcctgattttgtcattgaaggatgagcatgatttttccagatggtggaagcaggtgcttctggcagaagaccccacataagcaaatgtgtaaaatccacaaggcatggccttcaacaagagcaggtctggggcggtggctcatgtcaaggtgggaggctcacttgaggccaggagttcaagagtagcccagtcaatatagtgagatcccatctctaacatattttttcaaaaaattagctgggtggctggatcatgcctgtagaaccagctactcaggaggctgaggtgggaggatggcttgagcccaggagtttgaagctgtagttcgctgtgattgtggcactgcacttcagccttggctacagagtgagaccctgtctccaaaacataaacaaaataaccccaacagcattacaataaatatacaataagcatccacacggcatgtgtgggagactgtgcttatgctgatggcatgggcaggaggaaggcaggcatctggggagtgtgggtgcacgggaggacagggagggtcccacaggctgtcagtggcaggtctttcttcctgaagaccactgcagacccccaaccctgaggatgcgaggcaggtgggttggatgagagggacctgggtgtttcgtctgcggctgctcctctaagtacaacagcaaagagggtgggcctggactgaaggtggtgctggggagcagcctgtttgctgtgcttgatcacgagttgctgggaagttgtgacattcaccttccctttccaatttcatagttatctgggaggccagaggacgtgtctggttattacacaggtgcacagctggagatgggatccacaaagctcggaacagctggatcttgctcagtctctgtcaggggaagattcctcggtaagtcggggaccgttgacctgcccccatctccttattctcaacaatagctccatgaaggaaggatcattccgcttttgtagataagttcagagacgttagtaactggttcagatcagacaggaaagcagtagcagagtcgggatttgcacccaggcttgagtctgatgctccctccctcctgctgtgcccttaaacagtagagagaggccgggaaacaggtcagatgggttcacaaagctccctgggctcagctctggtttagactgtggagacacagctgggggaccccagaaggaaggtctgtgttgggggtgcctgactctttaggaaatttgaaggaaccaaagaaggtggaggtggggaggtgacccggactctggtctgtccttatggcctggaaacacccaggctggccccagggtgctgctgctgaggcccaatgggaacgacaaatttattttgagatacaaggaacctagaggtcatctcaccacccccccctccaagtctgagcaccaacttgtgccaggccctgtggggaaactgaggccctgggaggggagtgacttgcccagggtcctgtgtctggaggctgagcaggtagctcgtaggactccacgtctctggccctcacctctgtccctctcttcagacctctggggggatggagaagaaacaggctgtgctgtgtccctaatgggaaacgtggctgagacaggggagtgagaagggcgtgctgtggaatagtgtctgtggcatgatgccagctttgcaatcaagagattcaagaaccacactgtggaattgtggatataactacaggagtgacagcttagatctctgtgtttgtagaagcagaatcaaacctggaaactcttggattatcaaaattatacatttttgcttctatatcagagtcataaggccagatgttggcctcccctctgccctccaagagctgtgtgactctgggcaagtcacctccgctctcagcctgagtattctcccctctcaaaaacctgatagagctgccaaaagtacatgaaatcggggggaaatttctgtgaaatctgagtcatggtcttctttttcttcactaagaagagatgcccgtcaagatagaaagcactatggctgtggcttgtaaccccagtgctgtgggaggtagaggcgggaggatcactagaggctgggagttcaagacagcctggaaaacacaggagatgctgtctctatgaaattaaaaatgaacaaattagcccagcatggtggcgtgcacctgtagtcccagctactcagagggttgaaggaggaggatctcttgagcccagtagatctaggctgcaatgagctaggatggcgccaaagcactccagcctgggtgacagagcaaaaccgtttctcaaaaatgaaatgaaaatggtgatttctcaggaggaccacactgtgtcgaccctctattcctgcccaaggaggaggccccgcagtgacatggagggtgctgctttgctgagactctttgtcctctgcatctggtgagcttggctcagagtgctgaggtgggagggaggtccccggtctgggctgcacagttgggcagggcttgggctgggcctgggccatctgggtttctttcaggaaccaaagtcccttcccagaattgaccaaccagcagactcgcccagggagaacctgctgtatcctagtcaaggctaacgggcaatatccagcctcaattctcagcagaggccccagatcagggtctgagccaggccaacaatgaccaaagaggatgggatcctgggtgcagctcctcacaagtgtcgggcgagtctgaggcctcagctctctctgccctcctgctcctctgctctctcctggtcctcctgtgtcctcatggatcatgagatggctgtcctggcccagggggtcatacagtgagcaaagcaggaacaaggggaagggaaccccctctcctgtcacccctgtcccttatagcaagaagcacccagacacccctctgcatactgccctggtgaactgctgcccaggactgggtcccccttctacccttgctgcgtggggtcccagaagacagacatctgtgtgtctgaaccctgggataaaggcaggaaggggaaagagggaggcgagtggcttttgagagggggcttttgtatgagagctggaggatggaaccccatcagggggcccggaaaccactgagctgttaaaataaaggctgcaaacaaagaccagctgctggaagtgggtgtgccagggagggagcagagacacacggtgagaaaagagaaatggtaatgcctggagccgcccctgactgcgatgggcctgaagccgtattattagtagtaattatagtatcattattagtcattttcatcttatttgtatcctccgtctatctctcctctccaccttttcctaacattctatcaccagttttatgtcttccattagcaactttgtagctgtaaacagtttacttacaactttctcatgccctcagtagtacccagtatttcttgacttctctctttaaaaaatgacgatattaatcttccttctccttccttcagtgtttcacatcccaactgctacctttgtgctttaaattttgtactaattggtattagtaacaagtatatttagttctcacatttacatgttgtgtatatggttttttgtcctaaagaagagactactgagaaccagtgagactgagagaatgggcatcttcacgtactgctagtttgagtgtgaatttggtacaatgtgcatacagtgtggctgtaggtataaaacctaattctactcctacgaatatcttaaggaaataatctcaaatgtgagcaaagttttaggagaaggaggatgttctttgtagcataaattacatgaagaattagaaataccctaaggtccatcagccagagaggacagcagaggggacagggcagcaccaggagggctcggcagccacagcaggggctgcgccggcatctggcaggatccaggtctttgtgggacagaggaccttagagaagcgacggggacacaggctgtccgctgcagcagcagtgaattcaccaagacgaagagttgagcacagagtgtgagacacggatttgcaatgaggagtcatttcccatgagcgtgtatacatgactcaatattgtatattgaagggagtagagcacagtcattgaagacatggggttgaagcagaagtcctggctctagcactattgtgaaaacacgggcaggttccctaacttttgtggattcctctgtgtttgaaagggaaggtggtacccatctcccgggctgtgtgtgatcatcgaatgagacacgtgtaaggagccctgcacatcacagacactcaatacacactggctatcatcaaccagttatcacacatgttcccaggcccaggtcattgtcagaaccttcctccccatctctattcctgtgtatggactctgtagttttctgtaatgatcaggtggctgcccctcctctgattatcttctcctcataccccaacaggacaagcggacttttccttgctgtgggagtgagggcagaggaagctgcagcgaggtgagtgtctgtaaatagcaggtgatggggactcagtgacagagaaacaatctgggttaggttggtcttgacatttgctgccaccctagaaggatgtgcagagccccggctgctcaagcctccctctgtccacaggtggctcacattcaatcccacaatttgttttctcctcctcaagggtgcagcaaaaccatccaggtgggacagatacaggagatcctcaaggtaagcccctcagtgaccgggctgctggcaccatggacccaggtaggctcgcctcctcttccctggctggttcccactcgcacctagcacggagggtggtgcctccacagctgagtgaaccccagaggaacccagatggacaaggaggccaatgagtctgctccaagccccaagagaagccgcatagagtcccccgacccaggggtctgtggggccatctgcatcctgacttctcctcagggggggcacggcccaggagcccacttcctctctaccctggcactagcaaatgtctcaagtggggcaggagggccttggggaaatggaaccagcaggggaggggagtggggggagagcagggtccaggaggggagggctgggagagcaggttgaccagcagccccgacctgtcacctcccgctctgctcccagctgaccctgggtgtttctagccgaggctggtcccctccctccagctcttgccctgcaccagcccctctgctctgagtggccttgtgggaatgtatcaggcctgatccagcttccaacttaactggaccccggtctggcctttgccacgtcccctctgtgtgacctggcgcgccttacctcccctctcctgtaccatgagaataatatttccccatgttgtcttgaggatcaaatatgacacagctatctggcctggccggtgcctgccacacggtagggcctccctaagggctggttcccatcccctctacctgtcccctgttgattccaggtggaaggcacccagtcctcccagctgtgttaggggcacccgccctgccctgcccaccacaagcgcctgctgaccagggatgactgccccgggcaggggttgagtccagtcatctaaaatacccctggtcaaagaaaaatctgaggcccagtagaattttaaagagtttatttgagtaagaaagaattcttgaattgggaaacagcaaactggaggaggcttcgtgctatggtgaaaaagtgtgggagacaatgtttagcgggtgaatatgaaactgcaataaggacatgacttgattggttgcacttacaaaacttcctgttttggtttactttgttggaaaatccctggtcacattggtgttggtgagtttagggaggtctccgaatgcaggtgagaccggaccttagccttgcccaggtttttgacatccaagagagaaaaaggttaagtccaagcaaaagcaaaagcaaaagcaaaagcaaatcagcttttattgcaaagcggacgctcaggctcgggggtgggagtgcaggcggactcagaagagccagtcgggcccagtgtggtttggggtttctgcctttgctggtttattaaattaaggggtggagtaagcatgaagatttctgggaagaggtggggatttcttggaacttggcggggaggggtgggtaccacacagttttgtaccaaacacaggcatacatggaactgctgtggcgcgggtgggggtggggtttagtgagacaaggagggtatgattgagtgtgaggcgaatcgtgagtccgacccagcactgagttggatcttactggtcttcgccggattggccacttcctgtttgtcagggtcctgtaggcctgtcgcctccccctgtccctgcagctggtttcagcagctccttctgtgtctgtcatgggaaccagctgcctggagttcttgtttcttctatgacctcccagtattcccatctcagcatggcccgctgtcagctggctgctcgtgactggccgaggttaagttttgtttgtgtctaacagaagcgcccatctgatgtgaccccagttcagtttcccacagcttgcagtttaaggggggtgacagccgttctcaaggcctcgtaggtattgtttgcccaggaatgtttcagagctggattttgttttaattttgcttttatatccaccagccccaccccaccaagaaatatacagatttagtgctggaggttccttccatccaaccctgggtttccttcttccttttggtgaagaaggaaaaagaaaaaaccagacaagtcctcgcccagccgagtcagcactgcgttcatttccctaagccccatttccttaggatggcttcctcccctcactgagttgcagtggcaaccaagtcagctctgctcaggagccgccctgtacagcaaactgggctgtgctgaatcctgtccaagaccaggggagggcagggaagattagaagccaggagctcctaggccaccccggattcctgggctgggctgggctagggggccaaggaagaaactgtccctcccaaacaggatgatctgtggtttaataccaaatcacaggcatttttaaaacacaaggagtcttcgaagcaatgtcaaggaaacgttggccttggagtcaaatcctgagcttcctgcttgctggttttgggcggtgactctcgctgtctggattttactttcttcttctgtgaattaagaatgaggccccttgtgtgtccacagcaggaaacaattttacatcatgtctcggtgcacacacaaatacatactggtccccagtccattatctgtaattccataatttccagatccctgcaaaccacacattttgggggcagctgacttcaggagtaatcctgctctgtactgactcgagttctttgtaggcctaccattatttaccccatttaatgtgaatatttgcttgtttcactgttgaaacatgtgtgggtttgattacggggagcagtctagcctctgctgggaatggtcaggaatataccatatgcaccccgtgtcctttctaaaatagtgaaaattcggaatgcctaaacacatctggattccaggaatttacattaagggatatatatttgaaataactcacaaaaaacaatactcatccctgctgtgattgctatattctgatattttcaaatcgattttcttttcaaaatgctgctcttgaaccaataaactaatttcataacccaatgatgtgttgaaactcacattttgaagacacaggtataaagtgtttgacacccaacaggcacgtggcagatagaagtgatcactgggatgtttcctcttccttggcctggaaggctcactttgtgttggttctgagctgaaaaggattcattcctccccaaagcactgtggcactcccctggtgtttcaatattctcaggctgccatggtaaaatatcacaggctgggtgacttcaacatctggtttttcttttctcacacttccagaggcaagaagtccaaggcgaaggtgccggcagggttggagtctggggaggactctcttgctggcttgtggaggctgcctttgtgctgtgtgatcacgtggcttgcttgtgtctctttcacttcctacaataggacactagccctctaacaggattagagtcctacccttgcgatctcattcagtcttttttttttttttttttttgagacggagtctcgctctgtcacccaggctggagtgcagtggccggatctcagctcactgcaagctccgcctcctgggttcacgccattctcctgcctcagcctcccgagtagctgggactacaggcgcctgtcacctcgcccggctaagtttttgtatttttagtagagacggggtttcactgtgttagccaggatggtctcgatctcctgacctcgtgatccgcccgtctcggcctcccaaagtgctgggattacaggcttgagccaccgcgcccagccctcattcagtcttaattgcttccttaaaggcctgatctccaaatatagtcacctgactttagggcttcagcatatgaattttgggggcatacaattcccttgatagcactgatgactccatcaaacgtatcccacaccacagctgtcctggaaaattaacacgtaaccatcttttacgcaatggctgttatctcctctacactttcctccaacctgatccttttttctttccaactagagagcaacatttctcttgaggattaccttaattatttccagaaaaacgtgagcccacaggagctgctactcctgctgagtgaccataaagcctgggagagagtggtggctactgctgaactgcccaggtaacctccatggggttatctccattgggaaccctggtgatgccacccagatctcccttgggctagttttccctgacagacacacctcctccaggcaggcccctctgctgggcttgaggatgaccttctcggcagtccaggaggaacatttcctcccaatccttcgctggcagtgagtagcctcaggctgaggggacaggaagcccacagggacagggtcatttctgccatctgctggtgatgggaaatttgcgagttactttcccactttcagcctttcttcatccatggagttttattgtgagaaaaatgagatcatgcatgtaaagtactcagcataatgactgacacatagtaggtgcacagttaacgttaacatcttacaaggttggtggaaatagaccagggtcaagggtcttcctcttgaagtccagcagcacttcctttgggacaagtccgaaaaatcctgacttaattgatgtgtgttcctggggatgctggctggggccttttttctcatctgaggaattccataaacacggcaggacccttctgctggtccaggatgctgagaggctggagtggacttggacagcgatgggtctctttccggctctgtctgtgcccagtccctgggctctaggcttatgtcatggagactgggaactgtcatctgtccaatagaaatagcaagtcaatgtcataggagtatggtgaaggccttagagtgaactccaggtcaaaggtggggaaccaagaccaagatcctggccaaaggccaagagagaccaagaccagtgtcaaagcctggggtcaggatggagcaagagtcagccttggttgtaggacaagtaggaaggttgaggcaccagggctgggactagggtgtggcaagagaggcaccaagggcttgaaacttaaggaggtcatgaacttgcagaggacatgtgagtgggagaggaatatttcttctctgtctgggagaggaatatttcttctctgtctggatgatcccaacactcatggacatagagggtcatggttgcctgtgtctctcacaccctgcctgggaactggcaagttctgggctaccctttgggaccttcttctcttctacacaaagaagcccctgacaatggcaagcagtatgccttagtgaccatctccatagtagaatgagttgctgtcaatgtatataatttcaggggtactgagcagactcacaagtccccaaccaagaaggaaaacacttcctctaccatcttgtccaaattcaggtcttttcagcgttagcaatttatatagatggttctgaaagtgtcccgagtcttctagaggttccataaaattgcacacggccttggcgtacacacaggtgaagctgtcactgctaaggcatcagttaggctggtgacatctgcgagtgagacctggaaggttgggggtgcagggggcaggtcaggaggcggtaaggtggctggagagtccatgtggagccagaatgaatacccagatctcccactccggtcaactggggcagtgcccggacccagtagccttcagccagaaagtgaaagggcatgaggccttggaagggagcacatgccaggcaaagtgagctcctgtctctctgaggtttggtttcgtttgaattcaaagtactcagaggtagccagacggcaatgtctgagggcaccttacctttgacgccacctgaacattaatggggattcctaaaatcatctttagattttataattcactagaaggattcatataactcactaaaaactgctatttcacgatcgtggtttatcacacagaaagaacacagattaaaatcagcctaaggaagagacacacagggcagagtctgggagggcttcaggtgtgaagcttcattgtcctcaggacgctgtgatctcctgtgccaatgtgggacaagacacatggggtgctgccaaccagggaagctcacccagttaaggaaacattcctgtgaatcacaagaaatcaggaaggaagcctttattcaggatggttgttacaggggagggagaccgagtccagctccaaacacagtaaagacagagagggagtcacagccaacaccagggtgaggggcggcagatggaacaggactaacaggagacaccagagtgggatgttcctgccaaactgtcctaacaggattctcgctaaaggcaggtcagacactcacccatcaacggtgggagtgaggagcatgatcagatagcaaagagtgctcagacagcaagcagggaggaccctccctaaaccgacttggggagattcttgctgagctgggcagtgcaagtccagcaagcagtgggtgggtgtggaaggccaaggtcggcgcctagtggagaagaagctctgaagcgccccgctggagctggtcaagcagaaagtctttctcaacccatgtcttagtgtccagaatatttgctggggttggatcacaagctgccctcatgactgacctgtagtctccagcccctccctgaggtctcacacctttagtccccaggtcctctggaagtcaggaaagacaccaaatagccccaaaccccatcatccatcacattgctgtactgtcccgtggccaaatcaccagacaaagaaagatgttcctaccaggcaggacactccaggagcctggagatcacttcccaggagctgaggacaaagggaaggcctctctttgggaaaagttcatgcttcactttgctaccatcctgggaataaggtgtctttgtcccactctcacggctctttgttcatctgcagagttttcccctctccaaacactttggcaatcacagtgttggcctgcccttgagtgaggaggcatctttatcaaacacctaccacgaaagagcatctgagatgcctttaagatatttatttccatatggaataagtactgaggggtatctatgatgaacaaagcatgtttgagcttaaattctcttcatttgtaaaatttgtttctatttgattgatagtgagagctctgcaatttacacaggatagagatcgcatggagccgatttcacagacagggaaactgcatttcttaatcctttaaactttccttgtgcagggatgaggcagatgagctctataaagctctgaacaagcttataagacacatggtcatgaaagacaaaaactggctcgaagaagtccagcagcacagaaagcggtttttggaagagtttcctcagttggaaagggagcttcaggataaaataagaaggctctgcgaccttgcaggtgaggttcagaaggtccacaaaggcgccaccatcgccaatgcgttctccagcactctcggcgttgcctctggtgtcctgaccttcctcggcatgggtctggcacccttcacagcggggagcagccttgtgctcttggaacctgtgacggggttgggaatcgcagccaccttgaccgggattaccagcggtagcgtggaatacgcaaagaagcggtcggcacaagccgaagcccatgaactggtcaacaaaagccttgacaccgtggaggagatgaacgagtttctgtatcacaacatacccaactttatttccttacgtgtcaatcttgtcaaattcacagaagacactgggaaggccatccgtgccatcaggcaagccagagccaaccctcactcagtaccacatgtcccagcctcactccaccgggtcactgagccagtctcagctacaagctttgaagagatggagagatggagagagttggagagatggagagagttgctgaatcccgcaccacgggggtgatcagaggagccaagatcgttgataaggtctttgaaggcgcccttttcgtgctggacgtagtcagcctcgtgtgccagttaaagcacttacatgagggggcaaagtcaaagacagctgaggagctgaagaaggtggctcaggagctggagaagaagctaaacattctcaacaagaagtatgagactctgcgccaagaaccgtgaccacagggcagggcaaccaccaggggagatatgcctgggacgggccaagacaaaatgcaaactttttttttttt

SEQ ID NO: 1950 - DNA, 16 bp, synthetic construct
  source 1..16: mol_type = other DNA
  modified_base 1: mod_base = OTHER; note = constrained ethyl thymidine 3'-phosphorothioate
  modified_base 2: mod_base = OTHER; note = constrained ethyl thymidine 3'-phosphorothioate
  modified_base 3: mod_base = OTHER; note = constrained ethyl thymidine 3'-phosphorothioate
  modified_base 4: mod_base = OTHER; note = 2'-deoxythymidine 3'-phosphorothioate
  modified_base 5: mod_base = OTHER; note = 2'-deoxyguanosine 3-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3-phosphorothioate
  modified_base 10: mod_base = OTHER; note = 2'-deoxythymidine 3'-phosphorothioate
  modified_base 11: mod_base = OTHER; note = 2'-deoxyguanosine 3-phosphorothioate
  modified_base 12: mod_base = OTHER; note = 5-methyl-2'-deoxycytidine 3-phosphorothioate
  modified_base 13: mod_base = OTHER; note = constrained ethyl adenosine 3'-phosphorothioate
  modified_base 14: mod_base = OTHER; note = constrained ethyl adenosine 3'-phosphorothioate
  modified_base 15: mod_base = OTHER; note = constrained ethyl 5-methylcytidine 3'-phosphorothioate
  modified_base 16: mod_base = OTHER; note = 5-methyl-2'-O-methoxyethylcytidine
ttttgtaagtgcaacc

What is claimed is:

1. A method of treating, preventing, or ameliorating a kidney disease associated with APOL1 in an individual comprising administering to the individual a compound according to the following formula (SEQ ID NO: 1950):

245

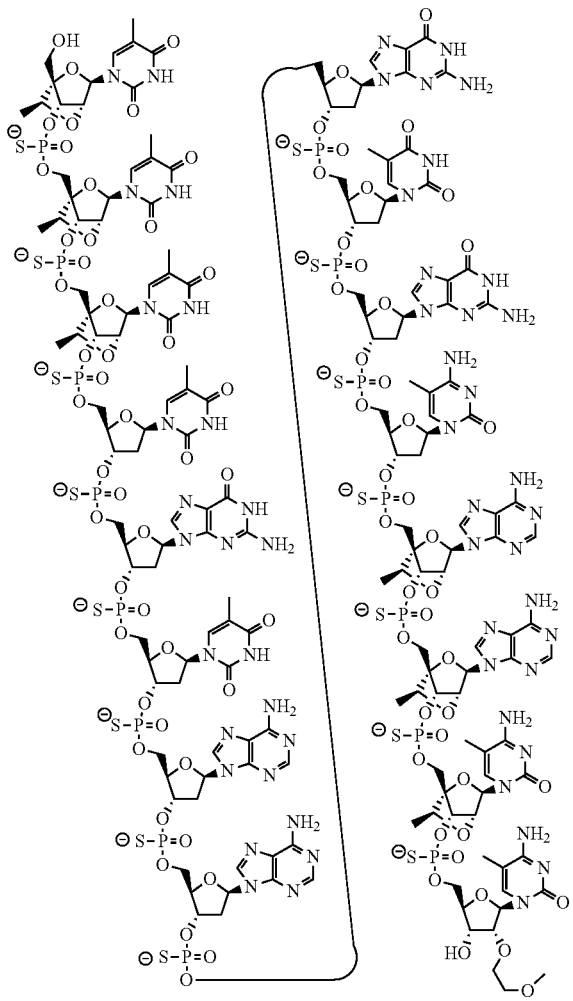

or a pharmaceutically acceptable salt thereof, thereby treating, preventing, or ameliorating the disease.

2. The method of claim 1, wherein the kidney disease associated with APOL1 is one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, and other forms of APOL1-associated proteinuric disease.

3. The method of claim 2, wherein administering the compound inhibits or reduces or improves any one of edema, proteinuria, albuminuria, GFR decline, high lipid levels, high cholesterol levels, nephrotic syndrome, high blood pressure or hypertension, kidney damage, glomerular damage, and kidney failure.

4. A method of reducing or inhibiting any one of edema, proteinuria, albuminuria, GFR decline, high lipid levels, high cholesterol levels, nephrotic syndrome, high blood pressure or hypertension, kidney damage, glomerular damage, and kidney failure in an individual having, or at risk of having, a kidney disease associated with APOL1 comprising administering a compound targeted to APOL1 to the individual, thereby reducing or inhibiting any one of edema, proteinuria, albuminuria, GFR decline, high lipid levels, high cholesterol levels, nephrotic syndrome, high blood pressure or hypertension, kidney damage, glomerular dam-

246 age, and kidney failure in the individual, wherein the compound targeted to APOL1 is the following formula (SEQ ID NO: 1950):

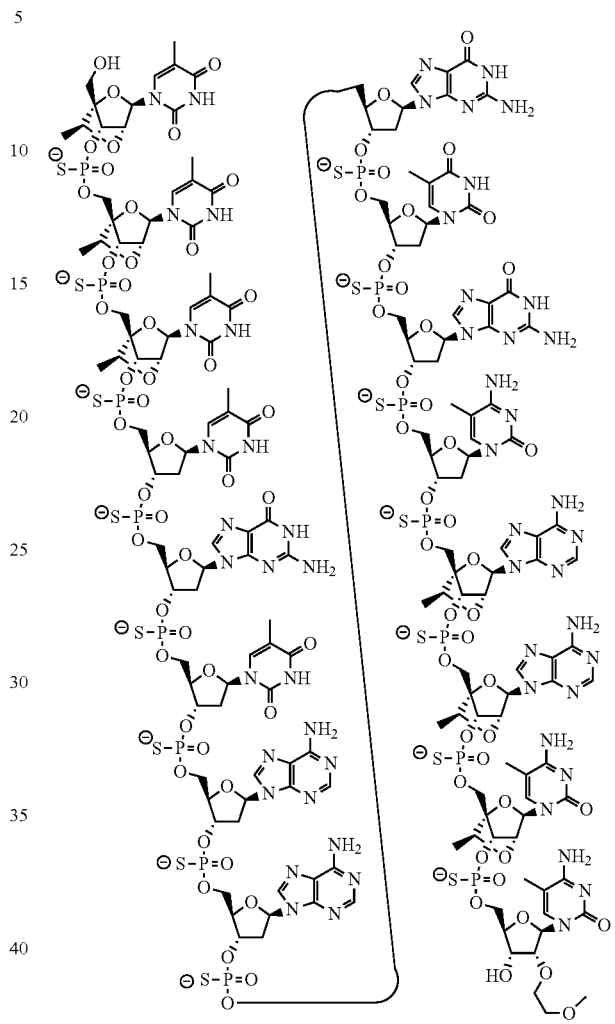

or a pharmaceutically acceptable salt thereof.

5. The method of claim 4, wherein the individual has, or is at risk of having, one of focal segmental glomerulosclerosis (FSGS), collapsing nephropathy, CKD, hypertension attributed nephropathy, HIV-associated nephropathy, sickle cell nephropathy, arterionephro-sclerosis, lupus nephritis, ESKD, and other forms of APOL1-associated proteinuric disease.

6. The method of claim 1, wherein the compound is administered parenterally.

7. The method of claim 4, wherein the compound is administered parenterally.

8. The method of claim 1, wherein the pharmaceutically acceptable salt is a potassium or sodium salt.

9. The method of claim 4, wherein the pharmaceutically acceptable salt is a potassium or sodium salt.

10. The method of claim 2, wherein the kidney disease associated with APOL1 is focal segmental glomerulosclerosis (FSGS).

11. The method of claim 1, wherein the compound is the following formula (SEQ ID NO: 1950):

247
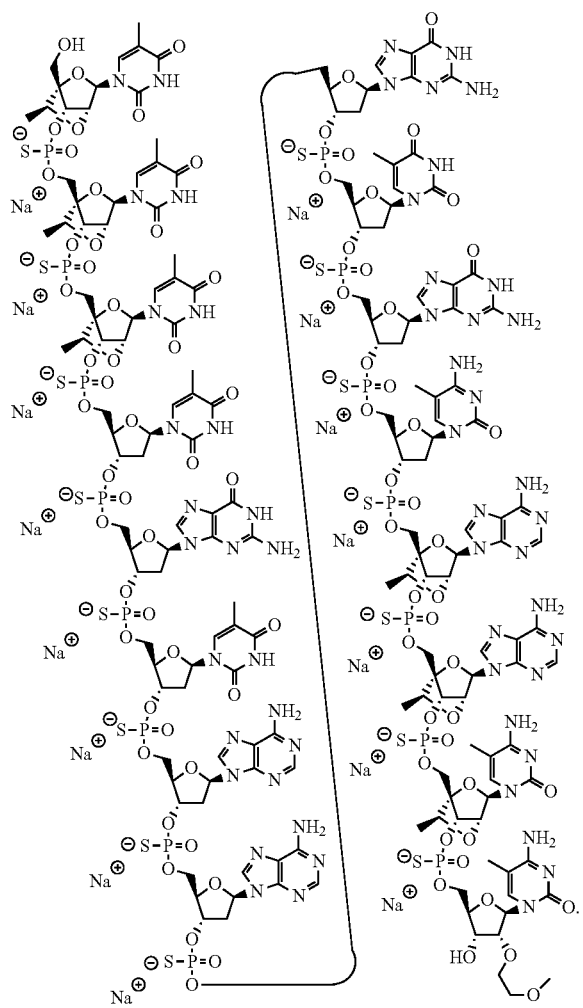
12. The method of claim 4, wherein the compound is the following formula (SEQ ID NO: 1950):
248
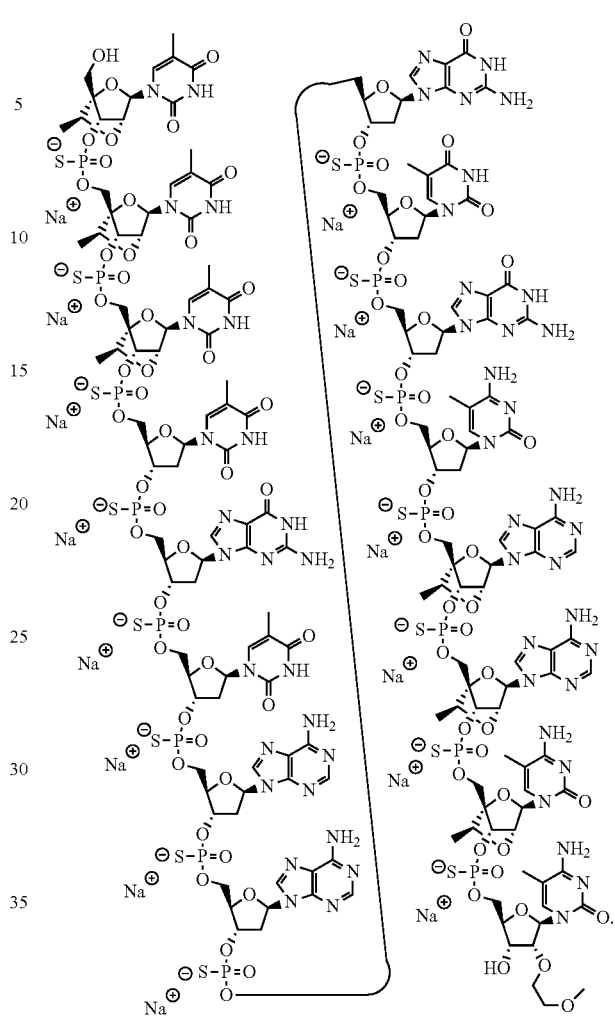
* * * * *